(12) United States Patent
Parks et al.

(10) Patent No.: US 12,311,021 B2
(45) Date of Patent: May 27, 2025

(54) REPLICATION-COMPETENT ATTENUATED CHIMERIC VSV VECTORS ENCODING IMMUNOGENIC SARS-CoV-2 SPIKE PROTEINS

(71) Applicants: International AIDS Vaccine Initiative Inc., New York, NY (US); Merck Sharp & Dohme LLC, Rahway, NJ (US)

(72) Inventors: Christopher Lee Parks, Boonton, NJ (US); Maoli Yuan, Brooklyn, NY (US); Mark Feinberg, New York, NY (US); Amy Espeseth, Chalfont, PA (US); Andrew J. Bett, West Point, PA (US)

(73) Assignees: INTERNATIONAL AIDS VACCINE INITIATIVE INC., New York, NY (US); MERCK SHARP & DOHME LLC, Rahway, NJ (US)

( * ) Notice: Subject to any disclaimer, the term of this patent is extended or adjusted under 35 U.S.C. 154(b) by 525 days.

(21) Appl. No.: 17/180,147

(22) Filed: Feb. 19, 2021

(65) Prior Publication Data

US 2021/0338804 A1    Nov. 4, 2021

Related U.S. Application Data

(60) Provisional application No. 63/143,522, filed on Jan. 29, 2021, provisional application No. 63/079,944, filed on Sep. 17, 2020, provisional application No. 63/005,717, filed on Apr. 6, 2020, provisional application No. 62/989,128, filed on Mar. 13, 2020, provisional application No. 62/979,949, filed on Feb. 21, 2020.

(51) Int. Cl.

| | | |
|---|---|---|
| *A61K 39/215* | (2006.01) | |
| *C07K 14/145* | (2006.01) | |
| *C07K 14/165* | (2006.01) | |
| *C12N 7/00* | (2006.01) | |
| *C12N 15/86* | (2006.01) | |
| *A61K 39/00* | (2006.01) | |

(52) U.S. Cl.
CPC .......... *A61K 39/215* (2013.01); *C07K 14/145* (2013.01); *C07K 14/165* (2013.01); *C12N 7/00* (2013.01); *C12N 15/86* (2013.01); *A61K 2039/542* (2013.01); *C12N 2760/20234* (2013.01); *C12N 2760/20243* (2013.01)

(58) Field of Classification Search
CPC .. A61K 39/215; C07K 14/145; C07K 14/165; C12N 15/86; C12N 2760/20241; C12N 2770/20034
See application file for complete search history.

(56) References Cited

U.S. PATENT DOCUMENTS

| | | |
|---|---|---|
| 4,689,338 A | 8/1987 | Gerster |
| 5,057,540 A | 10/1991 | Kensil et al. |
| 5,238,944 A | 8/1993 | Wick et al. |
| 5,650,398 A | 7/1997 | Kensil et al. |
| 6,524,584 B2 | 2/2003 | Kensil |
| 6,645,495 B1 | 11/2003 | Kensil et al. |
| 6,693,086 B1 | 2/2004 | Dow et al. |

FOREIGN PATENT DOCUMENTS

| | | |
|---|---|---|
| CN | 111088283 B | 6/2020 |
| WO | 1996020013 A1 | 7/1996 |
| WO | 2001095919 A3 | 11/2002 |
| WO | 2003063899 A3 | 12/2003 |

OTHER PUBLICATIONS

Fitch, W. M., May 2000, Homology a personal view on some of the problems, TIG 16(5):227-231.*
Theiben, G., Feb. 2002, Secret life of genes, Nature 415:741.*
Jary, A., et al., Jul. 2020, Evolution of viral quasispecies during SARS-COV-2 infection, Clin. Microbiol. Infect. 26:1560.e1-1560.e4.*
Kapadia, S. U., et al., 2005, Long-term protection from SARS coronavirus infection conferred by a single immunization with an attenuated VSV-based vaccine, Virol. 340:174-182.*
Wu, F., et al., Feb. 3, 2020, A new coronavirus associated with human respiratory disease in China, Nature 579:265-284.*
NCBI Reference Sequence YP_009724390.1, submitted Jan. 17, 2020, Surface glycoprotein [Severe acute respiratory syndrome coronavirus 2].*
Rabinovich, S., et al., Sep. 2014, A novel, live-attenuated vesicular stomatitis virus vector displaying conformationally intact, functional HIV-1 envelope trimers that elicits potent cellular and humoral responses in mice, PLoS ONE 9(9):e106597, pp. 1-17.*

(Continued)

*Primary Examiner* — Jeffrey S Parkin
(74) *Attorney, Agent, or Firm* — Duane Morris LLP; Thomas J. Kowalski

(57) ABSTRACT

The present disclosure provides Severe Acute Respiratory Syndrome coronavirus 2 (SARS-CoV-2) vaccines, recombinant vesicular stomatitis virus (VSV) vectors encoding the SARS-CoV-2 spike (S) protein or an immunogenic variant thereof, recombinant replicable VSV particles having a SARS-CoV-2 S protein or an immunogenic variant thereof on the surface of the particles, and immunogenic recombinant proteins comprising a SARS-CoV-2 S protein or a variant thereof. Immunogenic compositions comprising the SARS-CoV-2 vaccines, the recombinant VSV vectors, the recombinant replicable VSV particles and/or the immunogenic recombinant proteins may be used for inducing an immune response to the SARS-CoV-2, preventing infection by the SARS-CoV-2, vaccinating against the SARS-CoV-2 and/or producing adaptive mutants of the recombinant replicable VSV particles.

20 Claims, 117 Drawing Sheets

Specification includes a Sequence Listing.

(56) References Cited

OTHER PUBLICATIONS

Garbutt, M., et al., May 2004, Properties of Replication-Competent Vesicular Stomatitis Virus Vectors Expressing Glycoproteins of Filoviruses and Arenaviruses, J. Virol. 78(10):5458-5465.*

Geisbert, T. W., et al., Jul. 2009, Single-Injection Vaccine Protects Nonhuman Primates against Infection with Marburg Virus and Three Species of Ebola Virus, J. Virol. 83(14):7296-7304.*

Rabinovich, S., et al., Sep. 2014, A Novel, Live-Attenuated Vesicular Stomatitis Virus Vector Dislaying Conformationally Intact, Functional HIV-1 Envelope Trimers That Elicits Potent Cellular and Humoral Responses in Mice, PLoS ONE, 9(9):e106597, pp. 1-17.*

Wu, F., et al., Mar. 2020, A new coronavirus associated with human respiratory disease in China, Nature 579:265-284, published online Feb. 3, 2020.*

GenBank: MN908947, Severe acute respiratory syndrome coronavirus 2 isolate Wuhan-Hu-1, complete genome, submitted Jan. 17, 2020.*

Monath, T. P., et al., 2019, rVSVdeltaG-ZEBOV-GP (also designated V920) recombinant vesicular stomatitis virus pseudotyped with Ebola Zaire Glycoprotein: Standardized template with key considerations for a risk/benefit assessment, Vaccine X 1:100009, pp. 1-23.*

Espeseth, A. S., et al., Jul. 2022, Preclinical immunogenicity and efficacy of a candidate COVID-19 vaccine based on a vesicular stomatitis virus-SARS-COV-2 chimera, eBioMedicine 82:104203, pp. 1-28.*

Ahmad-Nejad et al., "Bacterial CpG-DNA and lipopolysaccharides activate Toll-like receptors at distinct cellular compartments" Eur. J. Immunol. 32(7): 1958-1968 (2002).

Allcock, "The synthesis of functional polyphosphazenes and their surfaces," App. Organometallic Chem. 12(10-11): 659-666 (1998).

Altschul & Gish, Local alignment statistics, Doolittle ed., Methods in Enzymology 266: 460-480 (1996).

Altschul et al., "Basic local alignment search tool," Journal of Molecular Biology 215(3): 403-410 (1990).

Andre et al., "Increased immune response elicited by DNA vaccination with a synthetic gp120 sequence with optimized codon usage," J. Virol. 72:1497-1503 (1998).

Anonymous, "IAVI and Batavia Biosciences Announce Collaboration," Retrieved from the Internet on Jul. 22, 2021: URL:https://www.iavi.org/news-resources/press-releases/2020/iavi-and-batavia-announce-collaboration-vsv-vector-epidemic-preparedness-vaccines. 7 pages (2021).

Anonymous, "Merck Discontinues Development of SARS-CoV-2/COVID-19 Vaccine Candidates; Continues Development of Two Investigational Therapeutic Candidates," Retrieved from the Internet on Jan. 25, 2021: RL:https://s2.q4cdn.com/584635680/files/doc news/Merck-Discontinues-Development-of-SARS-COV-2COVID-19-Vaccine-Candidates-Continues-Development-of-Two-Investigational-Therapeutic-Cand-9BOGI.pdf. 3 pages (2021).

Barouch et al., "Control of viremia and prevention of clinical AIDS in rhesus monkeys by cytokine-augmented DNA vaccination," Science 290:486-492 (2000).

Bosch, et al. "Cathepsin L Functionally Cleaves the Severe Acute Respiratory Syndrome Coronavirus Class I Fusion Protein Upstream of Rather than Adjacent to the Fusion Peptide," Journal of Virology, 82(17): 8887-8890 (2008).

Boyer et al., "Next generation DNA vaccines for HIV-1", Liposome Res. 12(1-2):137-142 (2002).

Case, et al., "Neutralizing antibody and soluble ACE2 inhibition of a replication-competent VSV-SARS-CoV-2 and a clinical isolate of SARS-CoV-2," Cell Host & Microbe, 28, 475-485 (2020).

Chan, et al., "Simulation of the clinical and pathological manifestations of Coronavirus Disease 2019 (COVID-19) in golden Syrian hamster model: implications for disease pathogenesis and transmissibility," epub ahead of print: Clin Infect Dis. Mar. 26;ciaa325 (2020).

Chuang et al., "Toll-like receptor 9 mediates CpG-DNA signaling," J. Leuk. Biol. 71(3): 538-544 (2002).

Database Accession No. MN908947, Zhang et al. "Wuhan seafood market pneumonia virus isolated Wuhan-Hu-1, complete genome." 16 pages (2020).

Davis et al., "Direct gene transfer in skeletal muscle: plasmid DNA-based immunization against the hepatitis B virus surface antigen," Vaccine 12: 1503-1509 (1994).

Davis et al., "DNA-based immunization induces continuous secretion of hepatitis B surface antigen and high levels of circulating antibody," Hum. Mol. Gen. 2: 1847-1851 (1993).

Dietzgen et al., "The family Rhabdoviridae: mono- and bipartite negative-sense RNA viruses with diverse genome organization and common evolutionary origins," Virus Res. 227:158-170 (2017).

Fathi, et al. "Recombinant vesicular stomatitis virus vector vaccines for WHO blueprint priority pathogens," Human Vaccines & Immunotherapeutics, 15(10): 2269-2285 (2019).

Gallo et al., "The central role of the nasal microenvironment in the transmission, modulation, and clinical progression of SARS-CoV-2 infection," Mucosal Immunology 14:305-316 (2021).

Garbutt et al., "Properties of replication-competent vesicular stomatitis virus vectors expressing glycoproteins of filoviruses and arenaviruses," J Virol 78, 5458-5465 (2004).

Gish & States, "Identification of protein coding regions by database similarity search," Nature Genetics 3: 266-272 (1993).

Green et al., "Enhancement of Antibodies to the Human Immunodeficiency Virus Type 1 Envelope by Using the Molecular Adjuvant C3d," J. Virol. 77(3): 2046-2055 (2003).

Hennrich, et al. "Safe and effective two-in-one replicon-and-VLP minispike vaccine for COVID-19: Protection of mice after a single immunization," PLOS Pathogens, 17(4): e1009064 (2021).

Hoffman et al., "Protection against malaria by immunization with a Plasmodium yoelii circumsporozoite protein nucleic acid vaccine" Vaccine 12: 1529-1533 (1994).

Hoffmann, et al., "A Multibasic Cleavage Site in the Spike Protein of SARS-COV-2 is Essential for Infection of Human Lung Cells," Molecular Cell, 78: 779-784 (2020).

Huang, et al., "Structural and functional properties of SARS-CoV-2 spike protein: potential antivirus drug development for COVID-19," Acta Pharmacologica Sinica, 41:1141-1149 (2020).

Johnston et al., "Chapter 17 Gene Gun Transfection of Animal Cells and Genetic Immunization," Meth. Cell Biol. 13:353-365 (1994).

Jones et al., "Live attenuated recombinant vaccine protects nonhuman primates against Ebola and Marburg viruses," Nature Medicine 11, 786-790 (2005).

Karlin & Altschul, "Applications and statistics for multiple high-scoring segments in molecular sequences," Proc. Natl. Acad. Sci. USA 90: 5873-5877 (1993).

Karlin & Altschul, "Methods for assessing the statistical significance of molecular sequence features by using general scoring schemes," Proc. Natl. Acad. Sci. USA 87: 2264-2268 (1990).

Lawson et al., "Recombinant vesicular stomatitis viruses from DNA," Proc Natl Acad Sci USA 92, 4477-4481 (1995).

Lee et al., "Oral SARS-CoV-2 Inoculation Establishes Subclinical Respiratory Infection with Virus Shedding in GoldenSyrian Hamsters," Cell Reports Medicine 1(100121):14 pages (2020).

Li et al., "Angiotensin-convertin enzyme 2 is a functional receptor for the SARS coronavirus," Nature, 426: 450-454 (2003).

Lingnau, K. et al., "Poly-L-arginine synergizes with oligodeoxynucleotides containing CpG-motifs (CpG-ODN) for enhanced and prolonged immune responses and prevents the CpG-ODN-induced systemic release of pro-inflammatory cytokines," Vaccine 20(29-30): 3498-508 (2002).

Mcsorley, S. J. et al., "Bacterial flagellin is an effective adjuvant for CD4+ T cells in vivo," J. Immunol. 169(7): 3914-9 (2002).

Mowat, A. M. et al., "CTA1-DD-Immune Stimulating Complexes: a Novel, Rationally Designed Combined Mucosal Vaccine Adjuvant Effective with Nanogram Doses of Antigen." J. Immunol. 167(6): 3398-405 (2001).

Myers & Miller, "Optimal alignments in linear space," Comput Appl Biosci 4(1):11-17 (1988).

Novella, "Contributions of vesicular stomatitis virus to the understanding of RNA virus evolution," Curr Opin Microbiol 6:399-405 (2003).

(56) References Cited

OTHER PUBLICATIONS

Payne, L. G. et al., "Water-Soluble Phosphazene Polymers for Parenteral and Mucosal Vaccine Delivery," Pharm. Biotechnol. 6: 473-493 (1995).

PCT, Search Report and Written Opinion for PCT/US2021/018869, dated Aug. 11, 2021, 17 Pages.

Pearson & Lipman, "Improved tools for biological sequence comparison," Proc. Natl. Acad. Sci. USA; 85: 2444-2448 (1988).

Rabinovich et al., "A novel, live-attenuated vesicular stomatitis virus vector displaying conformationally intact, functional HIV-1 envelope trimers that elicits potent cellular and humoral responses in mice," PLoS One. Sep. 2014. 12;9(9):e106597 (2014).

Robinson et al., "Protection against a lethal influenza virus challenge by immunization with a haemagglutinin-expressing plasmid DNA," (1993) Vaccine 11:957-960.

Rose et al., "Glycoprotein exchange vectors based on vesicular stomatitis virus allow effective boosting and generation of neutralizing antibodies to a primary isolate of human immunodeficiency virus type 1," J. Virol. 74(23):10903-10910 (2000).

Schellack et al. Proceedings of the 34th Annual Meeting of the German Society of Immunology (2003).

Song et al., "From SARS to MERS, thrusting Coronaviruses into the spotlight," Viruses, 11,59:1-58 (2019).

Suresh et al., "Tissue Distribution of ACE2 Protein in Syrian Golden Hamster (*Mesocricetus auratus*) and Its Possible Implications in SARS-CoV-2 Related Studies," Front. Pharmacol. 11:579330 (2020).

Tang et al., Coronavirus membrane fusion mechanism offers a potential target for antiviral development, Antiviral Res (2020), doi:10.1016/j.antiviral.2020.104792.

Ujike, et al., "The contribution of the cytoplasmic retrieval signal of severe acute respiratory syndrome coronavirus to intracellular accumulation of S proteins and incorporation of S protein into virus-like particles," Journal of General Virology, 97: 1853-1864 (2016).

Veazey et al., "Use of a Small Molecule CCR5 Inhibitor in Macaques to Treat Simian Immunodeficiency Virus Infection or Prevent Simian—Human Immunodeficiency Virus Infection," J. Exp. Med. 198: 1551-1562 (2003).

Wan, Y. et al., Receptor recognition by novel coronavirus from Wuhan: An analysis based on decade-long structural studies of SARS, J. Virol. 94(7): e00127-20 (2020).

Watanabe et al., "Liposome-mediated DNA transfer into chicken primordial germ cells in vivo," Mol. Reprod. Dev. 38:268-274 (1994).

Webster et al., "Protection of ferrets against influenza challenge with a DNA vaccine to the haemagglutinin," Vaccine 12: 1495-1498 (1994).

Witko et al., "An efficient helper-virus free method for rescue of recombinant paramyxoviruses and rhadoviruses from a cell line suitable for vaccine development" J Virol Methods 135, 91-101 (2006).

Wrapp, et al., "Cryo-EM structure of the 2019-nCoV spike in the prefusion conformation," Science 367:1260-1263 (2020).

Xiang et al., "Vaccination with a plasmid vector carrying the rabies virus glycoprotein gene induces protective immunity against rabies virus," Virology 199: 132-140 (1994).

Xu et al., "High expression of ACE2 receptor of 2019-nCoV on the epithelial cells of oral mucosa," International Journal of Oral Science 12:8 (2020).

Yahalom-Ronen, et al., "A single dose of recombinant VSV-ΔG-spike vaccine provides protection against SARS-CoV-2 challenge" bioRxiv: The Preprint Server for Biology, 26 pages (Jun. 19, 2020).

Zhou, P. et al., A pneumonia outbreak associated with a new coronavirus of probable bat origin, Nature 579:270-273 (2020).

Zhu, et al., "Design of Potent Membrane Fusion Inhibitors against SARS CoV-2, an Emerging Coronavirus with High Fusogenic Activity," Journal of Virology, 94(14): e00635-20, 12 pages (2020).

Ziegler et al., "SARS-CoV-2 receptor ACE2 is an interferon-stimulated gene in human airway epithelial cells and is detected in specific cell subsets across tissues," Cell 181(5):1016-1035 (2020).

Zuber, A. K. et al., "Topical delivery of imiquimod to a mouse model as a novel adjuvant for human immunodeficiency virus (HIV) DNA," Vaccines 22(13-14): 1791-1798 (2004).

\* cited by examiner

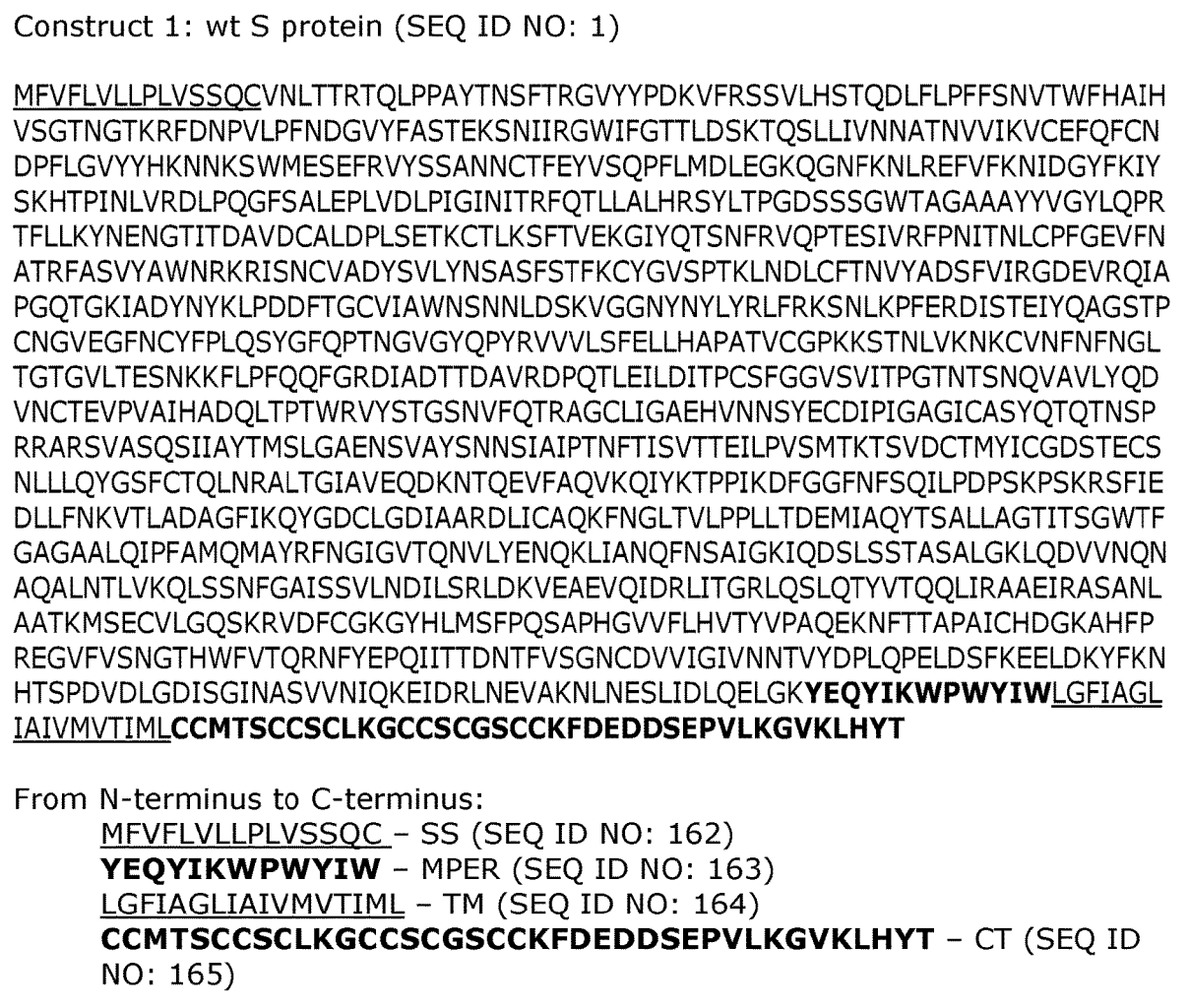

Construct 1: wt S protein (SEQ ID NO: 1)

MFVFLVLLPLVSSQCVNLTTRTQLPPAYTNSFTRGVYYPDKVFRSSVLHSTQDLFLPFFSNVTWFHAIH
VSGTNGTKRFDNPVLPFNDGVYFASTEKSNIIRGWIFGTTLDSKTQSLLIVNNATNVVIKVCEFQFCN
DPFLGVYYHKNNKSWMESEFRVYSSANNCTFEYVSQPFLMDLEGKQGNFKNLREFVFKNIDGYFKIY
SKHTPINLVRDLPQGFSALEPLVDLPIGINITRFQTLLALHRSYLTPGDSSSGWTAGAAAYYVGYLQPR
TFLLKYNENGTITDAVDCALDPLSETKCTLKSFTVEKGIYQTSNFRVQPTESIVRFPNITNLCPFGEVFN
ATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTP
CNGVEGFNCYFPLQSYGFQPTNGVGYQPYRVVVLSFELLHAPATVCGPKKSTNLVKNKCVNFNFNGL
TGTGVLTESNKKFLPFQQFGRDIADTTDAVRDPQTLEILDITPCSFGGVSVITPGTNTSNQVAVLYQD
VNCTEVPVAIHADQLTPTWRVYSTGSNVFQTRAGCLIGAEHVNNSYECDIPIGAGICASYQTQTNSP
RRARSVASQSIIAYTMSLGAENSVAYSNNSIAIPTNFTISVTTEILPVSMTKTSVDCTMYICGDSTECS
NLLLQYGSFCTQLNRALTGIAVEQDKNTQEVFAQVKQIYKTPPIKDFGGFNFSQILPDPSKPSKRSFIE
DLLFNKVTLADAGFIKQYGDCLGDIAARDLICAQKFNGLTVLPPLLTDEMIAQYTSALLAGTITSGWTF
GAGAALQIPFAMQMAYRFNGIGVTQNVLYENQKLIANQFNSAIGKIQDSLSSTASALGKLQDVVNQN
AQALNTLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAHFP
REGVFVSNGTHWFVTQRNFYEPQIITTDNTFVSGNCDVVIGIVNNTVYDPLQPELDSFKEELDKYFKN
HTSPDVDLGDISGINASVVNIQKEIDRLNEVAKNLNESLIDLQELGKYEQYIKWPWYIWLGFIAGL
IAIVMVTIMLCCMTSCCSCLKGCCSCGSCCKFDEDDSEPVLKGVKLHYT

From N-terminus to C-terminus:

MFVFLVLLPLVSSQC – SS (SEQ ID NO: 162)
YEQYIKWPWYIW – MPER (SEQ ID NO: 163)
LGFIAGLIAIVMVTIML – TM (SEQ ID NO: 164)
CCMTSCCSCLKGCCSCGSCCKFDEDDSEPVLKGVKLHYT – CT (SEQ ID NO: 165)

*Fig. 1A*

Construct 1: nucleotide sequence of wt S protein to be added to Vector A (SEQ ID NO: 2)

ctcgagaggagccaccatgttcgtgttcctggtgctattacctctggtttcgtctcaatgcgtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcagggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacgggactattacagacgcagtcgattgcgcactggatccactctcag
agacaaagtgcactctaaaatcattcactgtcgagaaaggaatctatcaaacatcaaatttcagggtccagccaactgagagtattgtc
cggttccctaacataactaacttgtgccccttcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgtttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttccctgcaatcatatgggtttcaaccaaccaatggagtcggatatcaacca
tatcgtgtcgtcgtccttcctccgagctgcttcatgcaccagctactacagtctgcggacctaagaagagcactaatcttgtcaagaacaaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatctaatttgtgcccagaaattcaatggactgacagtcctgcctcccttattaac
tgatgagatgatagctcagtatacatcagcattgttggctggtacaattacatctggatggacatttggtgccggagcggcattacaaa
tcccttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgacttttgtg
gaaagggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagttttcgtttctaatggaacccattggttcgt
gacccaaaggaacttttacgagcctcaaataattacaactgataatacattcgtttctggaaattgcgacgtagttataggtattgtaaa
taatactgttatgaccctttacaacctgaactcgattccttcaaggaagaactcgacaaatatttaagaatcacacctcaccggacgtt
gacttaggagacatttccgggattaacgctagtgtagtcaatatccaaaaggagatagatagactgaatgaggtagcaaagaatctt
aatgaatctttgatcgaccttcaggagctggggaagtacgaacaatacataaaatggccatggtacatttggctcgggtttattg
ctggactaattgcaatagtcatggtcactatcatgctgtgttgtatgacatcgtgctgctcatgcctcaagggatgttgtagctg
tggatcttgttgcaagttcgatgaggatgattcagaaccagttttaaaaggagtaaagttgcattacacataaaggctag
c From 5' to 3':
    ctcgag - XhoI site
    aggagccacc - Kozak sequence (SEQ ID NO: 166)
    atgttcgtgttcctggtgctattacctctggtttcgtctcaatgc – SS (SEQ ID NO: 167)
    tacgaacaatacataaaatggccatggtacatttgg – MPER (SEQ ID NO: 168)
    ctcgggtttattgctggactaattgcaatagtcatggtcactatcatgctg – TM (SEQ ID NO: 169)
    **tgttgtatgacatcgtgctgctcatgcctcaagggatgttgtagctgtggatcttgttgcaagttcgatgaggat
    gattcagaaccagttttaaaaggagtaaagttgcattacaca** - CT (SEQ ID NO: 170)
    gctagc - NheI site

*Fig. 1B*

Construct 1: nucleotide sequence of wt S protein to be added to Vector B (SEQ ID NO: 3)

ttcgaacaactaatatcctgtcttctctatccctatgaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataacccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtacttttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgttgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttccctaacataactaactt
gtgccccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaactataactatttgtacagact
gtttagaaagtcgaatttgaaaccttttgaaagagacatatccaccgagatttaccaggcgggcagcacaccgtgtaatggtgtagaa
ggattcaattgttactttcccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaatacctaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaatttctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaaggggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttctaatggaacccattggttcgtgacccaaaggaacttttacga
gcctcaaataattacaactgataatacattcgtttctggaaattgcgacgtagttataggtattgtaaataatactgtttatgaccctttac
aacctgaactcgattccttcaaggaagaactcgacaaatattttaagaatcacacctcaccggacgttgacttaggagacatttccggg
attaacgctagtgtagtcaatatccaaaaggagatagatagactgaatgaggtagcaaagaatcttaatgaatctttgatcgaccttca
ggagctggggaagtacgaacaatacataaaatggccatggtacatttggctcgggtttattgctggactaattgcaatagtcat
ggtcactatcatgctg**tgttgtatgacatcgtgctgctcatgcctcaagggatgttgtagctgtggatcttgttgcaagttcg
atgaggatgattcagaaccagttttaaaaggagtaaagttgcattacaca**taaagctcaaatcctgcacaacagattcttcat
gtttgaaccaaatcaacttgtgatatcatgctcaaagaggccttaattaa From 5′ to 3′:

ttcgaaca - BstBI site
aggagccacc - Kozak sequence (SEQ ID NO: 166)
atgttcgtgttcctggtgctattacctctggtttcgtctcaatgc – SS (SEQ ID NO: 167)
tacgaacaatacataaaatggccatggtacatttgg - MPER (SEQ ID NO: 168)
ctcgggtttattgctggactaattgcaatagtcatggtcactatcatgctg – TM (SEQ ID NO: 169)
tgttgtatgacatcgtgctgctcatgcctcaagggatgttgtagctgtggatcttgttgcaagttcgatgaggatgattcagaaccagttttaaaaggagtaaagttgcattacaca - CT (SEQ ID NO: 170)
ttaattaa - PacI site

*Fig. 1C*

Construct 2: S protein with CT deletion (SEQ ID NO: 4)

<u>MFVFLVLLPLVSSQC</u>VNLTTRTQLPPAYTNSFTRGVYYPDKVFRSSVLHSTQDLFLPFFSNVTWFHA
IHVSGTNGTKRFDNPVLPFNDGVYFASTEKSNIIRGWIFGTTLDSKTQSLLIVNNATNVVIKVCEFQ
FCNDPFLGVYYHKNNKSWMESEFRVYSSANNCTFEYVSQPFLMDLEGKQGNFKNLREFVFKNIDG
YFKIYSKHTPINLVRDLPQGFSALEPLVDLPIGINITRFQTLLALHRSYLTPGDSSSGWTAGAAAYYV
GYLQPRTFLLKYNENGTITDAVDCALDPLSETKCTLKSFTVEKGIYQTSNFRVQPTESIVRFPNITNL
CPFGEVFNATRFASVYAWNRKRISNCVADYSVLYNSASFSTFKCYGVSPTKLNDLCFTNVYADSFV
IRGDEVRQIAPGQTGKIADYNYKLPDDFTGCVIAWNSNNLDSKVGGNYNYLYRLFRKSNLKPFERD
ISTEIYQAGSTPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGGVSVITPG
TNTSNQVAVLYQDVNCTEVPVAIHADQLTPTWRVYSTGSNVFQTRAGCLIGAEHVNNSYECDIPIG
AGICASYQTQTNSPRRARSVASQSIIAYTMSLGAENSVAYSNNSIAIPTNFTISVTTEILPVSMTKTS
VDCTMYICGDSTECSNLLLQYGSFCTQLNRALTGIAVEQDKNTQEVFAQVKQIYKTPPIKDFGGFN
FSQILPDPSKPSKRSFIEDLLFNKVTLADAGFIKQYGDCLGDIAARDLICAQKFNGLTVLPPLLTDEM
IAQYTSALLAGTITSGWTFGAGAALQIPFAMQMAYRFNGIGVTQNVLYENQKLIANQFNSAIGKIQ
DSLSSTASALGKLQDVVNQNAQALNTLVKQLSSNFGAISSVLNDILSRLDKVEAEVQIDRLITGRL
QSLQTYVTQQLIRAAEIRASANLAATKMSECVLGQSKRVDFCGKGYHLMSFPQSAPHGVVFLHVT
YVPAQEKNFTTAPAICHDGKAHFPREGVFVSNGTHWFVTQRNFYEPQIITTDNTFVSGNCDVVIGI
VNNTVYDPLQPELDSFKEELDKYFKNHTSPDVDLGDISGINASVVNIQKEIDRLNEVAKNLNESLID
LQELGKYEQYIKWPWYIW<u>LGFIAGLIAIVMVTIML</u>CCMTSCCS

From N-terminus to C-terminus:
    <u>MFVFLVLLPLVSSQC</u> – SS (SEQ ID NO: 162)
    YEQYIKWPWYIW – MPER (SEQ ID NO: 163)
    <u>LGFIAGLIAIVMVTIML</u> – TM (SEQ ID NO: 164)
    CCMTSCCS - CT (truncated; SEQ ID NO: 171)

*Fig. 1D*

Construct 2: nucleotide sequence of S protein with CT deletion to be added to Vector A (SEQ ID NO: 5)

ctcgagaggagccaccatgttcgtgttcctggtgctattacctctggtttcgtctcaatgcgtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcagggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacgggactattacagacgcagtcgattgcgcactggatccactctcag
agacaaagtgcactctaaaatcattcactgtcgagaaaggaatctatcaaacatcaaatttcagggtccagccaactgagagtattgtc
cggttccctaacataactaacttgtgccccttcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttcccctgcaatcatatgggtttcaaccaaccaatggagtcggatatcaacca
tatcgtgtcgtcgtcctttccttcgagctgcttcatgcaccagctacagtctgcggacctaagaagagcactaatcttgtcaagaacaaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatctaatttgtgcccagaaattcaatggactgacagtcctgcctcccttattaac
tgatgagatgatagctcagtatacatcagcattgttggctggtacaattacatctggatggacatttggtgccggagcggcattacaaa
tcccttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgacttttgtg
gaaaggggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagttttcgtttctaatggaacccattggttcgt
gacccaaaggaacttttacgagcctcaaataattacaactgataatacattcgtttctggaaattgcgacgtagttataggtattgtaaa
taatactgtttatgaccctttacaacctgaactcgattccttcaaggaagaactcgacaaatattttaagaatcacacctcaccggacgtt
gacttaggagacatttccgggattaacgctagtgtagtcaatatccaaaaggagatagatagactgaatgaggtagcaaagaatctt
aatgaatctttgatcgaccttcaggagctggggaagtacgaacaatacataaaatggccatggtacatttggctcgggtttattg
ctggactaattgcaatagtcatggtcactatcatgctgtgttgtatgacatcgtgctgctcataaaggctagc From 5′ to 3′:

- ctcgag - XhoI site
- aggagccacc - Kozak sequence (SEQ ID NO: 166)
- atgttcgtgttcctggtgctattacctctggtttcgtctcaatgc - SS (SEQ ID NO: 167)
- tacgaacaatacataaaatggccatggtacatttgg - MPER (SEQ ID NO: 168)
- ctcgggtttattgctggactaattgcaatagtcatggtcactatcatgctg - TM (SEQ ID NO: 169)
- tgttgtatgacatcgtgctgctca - CT (truncated; SEQ ID NO: 172)
- gctagc - NheI site

*Fig. 1E*

Construct 2: nucleotide sequence of S protein with CT deletion to be added to Vector B (SEQ ID NO: 6)

ttcgaacaactaatatcctgtcttctctatccctatgaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataacccagtgttaccatttaacgacggagtttatttcgcatcaa
ctgagaaatccaatatcattagaggctggatttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtacttttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgttgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttccctaacataactaactt
gtgccccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaactataactatttgtacagact
gtttagaaagtcgaatttgaaaccttttgaaagagacatatccaccgagatttaccaggcgggcagcacaccgtgtaatggtgtagaa
ggattcaattgttactttcccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaatacctaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaatttctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaaggggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttctaatggaacccattggttcgtgacccaaaggaacttttacga
gcctcaaataattacaactgataatacattcgtttctggaaattgcgacgtagttataggtattgtaaataatactgtttatgaccctttac
aacctgaactcgattccttcaaggaagaactcgacaaatattttaagaatcacacctcaccggacgttgacttaggagacatttccggg
attaacgctagtgtagtcaatatccaaaaggagatagatagactgaatgaggtagcaaagaatcttaatgaatctttgatcgaccttca
ggagctggggaagtacgaacaatacataaaatggccatggtacatttggctcgggtttattgctggactaattgcaatagtcat
ggtcactatcatgctgtgttgtatgacatcgtgctgctcataaagctcaaatcctgcacaacagattcttcatgtttgaaccaaatca
acttgtgatatcatgctcaaagaggccttaattaa From 5′ to 3′:

ttcgaaca - BstBI site
aggagccacc - Kozak sequence (SEQ ID NO: 166)
atgttcgtgttcctggtgctattacctctggtttcgtctcaatgc - SS (SEQ ID NO: 167)
tacgaacaatacataaaatggccatggtacatttgg - MPER (SEQ ID NO: 168)
ctcgggtttattgctggactaattgcaatagtcatggtcactatcatgctg - TM (SEQ ID NO: 169)
tgttgtatgacatcgtgctgctca - CT (truncated; SEQ ID NO: 172)
ttaattaa - PacI site

*Fig. 1F*

Construct 3: S protein with VSV-G-CT IND serotype (SEQ ID NO: 7)

<u>MFVFLVLLPLVSSQC</u>VNLTTRTQLPPAYTNSFTRGVYYPDKVFRSSVLHSTQDLFLPFFSNVTWFHAIH
VSGTNGTKRFDNPVLPFNDGVYFASTEKSNIIRGWIFGTTLDSKTQSLLIVNNATNVVIKVCEFQFCN
DPFLGVYYHKNNKSWMESEFRVYSSANNCTFEYVSQPFLMDLEGKQGNFKNLREFVFKNIDGYFKIY
SKHTPINLVRDLPQGFSALEPLVDLPIGINITRFQTLLALHRSYLTPGDSSSGWTAGAAAYYVGYLQPR
TFLLKYNENGTITDAVDCALDPLSETKCTLKSFTVEKGIYQTSNFRVQPTESIVRFPNITNLCPFGEVFN
ATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTP
CNGVEGFNCYFPLQSYGFQPTNGVGYQPYRVVVLSFELLHAPATVCGPKKSTNLVKNKCVNFNFNGL
TGTGVLTESNKKFLPFQQFGRDIADTTDAVRDPQTLEILDITPCSFGGVSVITPGTNTSNQVAVLYQD
VNCTEVPVAIHADQLTPTWRVYSTGSNVFQTRAGCLIGAEHVNNSYECDIPIGAGICASYQTQTNSP
RRARSVASQSIIAYTMSLGAENSVAYSNNSIAIPTNFTISVTTEILPVSMTKTSVDCTMYICGDSTECS
NLLLQYGSFCTQLNRALTGIAVEQDKNTQEVFAQVKQIYKTPPIKDFGGFNFSQILPDPSKPSKRSFIE
DLLFNKVTLADAGFIKQYGDCLGDIAARDLICAQKFNGLTVLPPLLTDEMIAQYTSALLAGTITSGWTF
GAGAALQIPFAMQMAYRFNGIGVTQNVLYENQKLIANQFNSAIGKIQDSLSSTASALGKLQDVVNQN
AQALNTLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAHFP
REGVFVSNGTHWFVTQRNFYEPQIITTDNTFVSGNCDVVIGIVNNTVYDPLQPELDSFKEELDKYFKN
HTSPDVDLGDISGINASVVNIQKEIDRLNEVAKNLNESLIDLQELGKYEQYIKWPWYIW<u>LGFIAGL
IAIVMVTIML</u>RVGIYLCIKLKHTKKRQIYTDIEMNRLGK

From N-terminus to C-terminus:
<u>MFVFLVLLPLVSSQC</u> – SS (SEQ ID NO: 162)
YEQYIKWPWYIW – MPER (SEQ ID NO: 163)
<u>LGFIAGLIAIVMVTIML</u> – TM (SEQ ID NO: 164)
RVGIYLCIKLKHTKKRQIYTDIEMNRLGK - Vector B VSV-G-CT IND
serotype (SEQ ID NO: 173)

*Fig. 1G*

Construct 3: nucleotide sequence of S protein with VSV-G-CT IND serotype to be added to Vector A (SEQ ID NO: 8)

<u>ctcgag</u>aggagccacc<u>atgttcgtgttcctggtgctattacctctggtttcgtctcaatgc</u>gtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcaggggtttatagttccgcaaataattgtacttttgaatacgtttcccaaccattcttaatggac
ttggagggaaaacagggaaattttaagaatctaagagaattcgtcttttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacgggactattacagacgcagtcgattgcgcactggatccactctcag
agacaaagtgcactctaaaatcattcactgtcgagaaaggaatctatcaaacatcaaatttcagggtccagcaactgagagtattgtc
cggttccctaacataactaacttgtgccccttcggagagggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttcccctgcaatcatatgggtttcaaccaaccaatggagtcggatatcaacca
tatcgtgtcgtcgtccttttccttcgagctgcttcatgcaccagctacagtctgcggacctaagaagagcactaatcttgtcaagaacaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcacccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatcaatttgtgcccagaaattcaatggactgacagtcctgcctcccttattaac
tgatgagatgatagctcagtatacatcagcattgttggctggtacaattacatctggatggacatttggtgccggagcggcattacaaa
tcccttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgactttgtg
gaaaggggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagttttcgtttctaatggaacccattggttcgt
gacccaaaggaacttttacgagcctcaaataattacaactgataatacattcgtttctggaaattgcgacgtagttataggtattgtaaa
taatactgtttatgaccctttacaacctgaactcgattccttcaaggaagaactcgacaaatatttaagaatcacacctcaccggacgtt
gacttaggagacatttccgggattaacgctagtagtcaatatccaaaaggagatagatagactgaatgaggtagcaaagaatctt
aatgaatctttgatcgaccttcaggagctggggaagtacgaacaatacataaaatggccatggtacatttgg<u>ctcggctttattg</u>
<u>ctggactaattgcaatagtcatggtcactatcatgctg</u>**cgagttggtatttatctttgcattaaattaaagcacaccaagaaaag
acagatttatacagacatagagatgaaccgacttggaaag**taaag<u>gctagc</u>

From 5' to 3':
    <u>ctcgag</u> - XhoI site
    aggagccacc - Kozak sequence (SEQ ID NO: 166)
    <u>atgttcgtgttcctggtgctattacctctggtttcgtctcaatgc</u> - SS (SEQ ID NO: 167)
    tacgaacaatacataaaatggccatggtacatttgg - MPER (SEQ ID NO: 168)
    <u>ctcggctttattgctggactaattgcaatagtcatggtcactatcatgctg</u> - TM (SEQ ID NO: 169)
    cgagttggtatttatctttgcattaaattaaagcacaccaagaaaagacagatttatacagacatagagatgaaccgacttggaaag - Vector B VSV-G-CT IND serotype (SEQ ID NO: 174)
    <u>gctagc</u> - NheI site

*Fig. 1H*

Construct 3: nucleotide sequence of S protein with VSV-G-CT IND serotype to Vector B (SEQ ID NO: 9)

ttcgaacaactaatatcctgtcttctctatccctatgaaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttctttcaaatgtaacttgg
ttccatgctatacatgtttccggaaccaatggaacaaagagatttgataacccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtactttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgttgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttccctaacataactaactt
gtgccccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaactataactatttgtacagact
gtttagaaagtcgaatttgaaacctttgaaagagacatatccaccgagatttaccaggcgggcagcacaccgtgtaatggtgtagaa
ggattcaattgttactttcccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaatacctaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaatttctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaagggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttctaatggaacccattggttcgtgacccaaaggaacttttacga
gcctcaaataattacaactgataatacattcgtttctggaaattgcgacgtagttataggtattgtaaataatactgtttatgaccctttac
aacctgaactcgattccttcaaggaagaactcgacaaatattttaagaatcacacctcaccggacgttgactaggagacatttccggg
attaacgctagtgtagtcaatatccaaaaggagatagatagactgaatgaggtagcaagaatcttaatgaatctttgatcgaccttca
ggagctggggaagtacgaacaatacataaaatggccatggtacatttggctcgggttattgctggactaattgcaatagtcat
ggtcactatcatgctgcgagttggtatttatctttgcattaaattaaagcacaccaagaaaagacagatttatacagacata
gagatgaaccgacttggaaag**taaagctcaaatcctgcacaacagattcttcatgtttgaaccaaatcaacttgtgatatcatgctc
aaagaggccttaattaa

From 5' to 3':
    ttcgaaca - BstBI site
    aggagccacc - Kozak sequence (SEQ ID NO: 166)
    atgttcgtgttcctggtgctattacctctggtttcgtctcaatgc - SS (SEQ ID NO: 167)
    tacgaacaatacataaaatggccatggtacatttgg - MPER (SEQ ID NO: 168)
    ctcgggttattgctggactaattgcaatagtcatggtcactatcatgctg - TM (SEQ ID NO: 169)
    **cgagttggtatttatctttgcattaaattaaagcacaccaagaaaagacagatttatacagacatagagatga
accgacttggaaag** - Vector B VSV-G-CT IND serotype (SEQ ID NO: 174)
    ttaattaa - PacI site

*Fig. 1l*

Construct 4: S protein with VSV-G-TM-CT IND serotype (SEQ ID NO: 10)

<u>MFVFLVLLPLVSSQC</u>VNLTTRTQLPPAYTNSFTRGVYYPDKVFRSSVLHSTQDLFLPFFSNVTWFHAIH
VSGTNGTKRFDNPVLPFNDGVYFASTEKSNIIRGWIFGTTLDSKTQSLLIVNNATNVVIKVCEFQFCN
DPFLGVYYHKNNKSWMESEFRVYSSANNCTFEYVSQPFLMDLEGKQGNFKNLREFVFKNIDGYFKIY
SKHTPINLVRDLPQGFSALEPLVDLPIGINITRFQTLLALHRSYLTPGDSSSGWTAGAAAYYVGYLQPR
TFLLKYNENGTITDAVDCALDPLSETKCTLKSFTVEKGIYQTSNFRVQPTESIVRFPNITNLCPFGEVFN
ATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTP
CNGVEGFNCYFPLQSYGFQPTNGVGYQPYRVVVLSFELLHAPATVCGPKKSTNLVKNKCVNFNFNGL
TGTGVLTESNKKFLPFQQFGRDIADTTDAVRDPQTLEILDITPCSFGGVSVITPGTNTSNQVAVLYQD
VNCTEVPVAIHADQLTPTWRVYSTGSNVFQTRAGCLIGAEHVNNSYECDIPIGAGICASYQTQTNSP
RRARSVASQSIIAYTMSLGAENSVAYSNNSIAIPTNFTISVTTEILPVSMTKTSVDCTMYICGDSTECS
NLLLQYGSFCTQLNRALTGIAVEQDKNTQEVFAQVKQIYKTPPIKDFGGFNFSQILPDPSKPSKRSFIE
DLLFNKVTLADAGFIKQYGDCLGDIAARDLICAQKFNGLTVLPPLLTDEMIAQYTSALLAGTITSGWTF
GAGAALQIPFAMQMAYRFNGIGVTQNVLYENQKLIANQFNSAIGKIQDSLSSTASALGKLQDVVNQN
AQALNTLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAHFP
REGVFVSNGTHWFVTQRNFYEPQIITTDNTFVSGNCDVVIGIVNNTVYDPLQPELDSFKEELDKYFKN
HTSPDVDLGDISGINASVVNIQKEIDRLNEVAKNLNESLIDLQELGKYEQYIKWPWYIW<u>SSIASFF
FIIGLIIGLFLVL</u>RVGIYLCIKLKHTKKRQIYTDIEMNRLGK

From N-terminus to C-terminus:
 <u>MFVFLVLLPLVSSQC</u> – SS (SEQ ID NO: 162)
 YEQYIKWPWYIW – MPER (SEQ ID NO: 163)
 <u>SSIASFFFIIGLIIGLFLVL</u> - Vector B VSV-G-TM IND serotype (SEQ ID NO: 175)
 RVGIYLCIKLKHTKKRQIYTDIEMNRLGK - Vector B VSV-G-CT IND serotype (SEQ ID NO: 173)

*Fig. 1J*

Construct 4: nucleotide sequence of S protein with VSV-G-TM-CT IND serotype to be added to Vector A (SEQ ID NO: 11)

<u>ctcgag</u>aggagccacc<u>atgttcgtgttcctggtgctattacctctggtttcgtctcaatgc</u>gtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatccttt
gctgattgttaataatgcaacaaatgtggtcattaaagtctgtgaattccaattttgcaatgatccatttctcggcgtctattaccacaaga
ataacaaatcttggatggagtcagagttcaggggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacgggactattacagacgcagtcgattgcgcactggatccactctcag
agacaaagtgcactctaaaatcattcactgtcgagaaggaatctatcaaacatcaaatttcagggtccagccaactgagagtattgtc
cggttccctaacataactaacttgtgccccttcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttcccctgcaatcatatgggtttcaaccaaccaatggagtcggatatcaacca
tatcgtgtcgtcgtcctttccttcgagctgcttcatgcaccagctacagtctgcggacctaagaagagcactaatcttgtcaagaacaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatcaatttgtgcccagaaattcaatggactgacagtcctgcctcccttattaac
tgatgagatgatagctcagtatacatcagcattgttggctggtacaattacatctggatggacatttggtgccggagcggcattacaaa
tccctttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgacttttgtg
gaaaggggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagttttcgtttctaatggaacccattggttcgt
gacccaaaggaacttttacgagcctcaaataattacaactgataatcattcgtttctggaaattgcgacgtagttataggtattgtaaa
taatactgtttatgacccttacaacctgaactcgattccttcaaggaagaactcgacaaatattttaagaatcacacctcaccggacgtt
gacttaggagacatttcgggattaacgctagtagtcaatatccaaaaggagatagatagactgaatgaggtagcaaagaatctt
aatgaatctttgatcgaccttcaggagctggggaagtacgaacaatacataaaatggccatggtacatttgg<u>agctctattgcct
cttttttctttatcatagggttaatcattggactattcttggttctc</u>**cgagttggtatttatctttgcattaaattaaagcacaccaag
aaaagacagatttatacagacatagagatgaaccgacttggaaag**taaa<u>gctagc</u>

From 5' to 3':
 <u>ctcgag</u> - XhoI site
 aggagccacc - Kozak sequence (SEQ ID NO: 166)
 <u>atgttcgtgttcctggtgctattacctctggtttcgtctcaatgc</u> - SS (SEQ ID NO: 167)
 tacgaacaatacataaaatggccatggtacatttgg - MPER (SEQ ID NO: 168)
 <u>agctctattgcctcttttttctttatcatagggttaatcattggactattcttggttctc</u> - Vector B VSV-G-TM IND serotype (SEQ ID NO: 176)
 cgagttggtatttatctttgcattaaattaaagcacaccaagaaaagacagatttatacagacatagagatgaaccgacttggaaag - Vector B VSV-G-CT IND serotype (SEQ ID NO: 174)
 <u>gctagc</u> - NheI site

*Fig. 1K*

Construct 4: nucleotide sequence of S protein with VSV-G-TM-CT IND serotype to be added to Vector B (SEQ ID NO: 12)

ttcgaacaactaatatcctgtcttctctatccctatgaaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataacccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtacttttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagacccctactcgtctgcatc
ggtcatatttgacaccaggagattcatcgtcaggatggaccgctggagcagctgcttactatgtgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttccctaacataactaactt
gtgccccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaaactataactatttgtacagact
gtttagaaagtcgaatttgaaaccttttgaaagagacatatccaccgagatttaccaggcgggcagcacaccgtgtaatggtgtagaa
ggattcaattgttactttccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaataccacccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaataggggcactgactggaattgcagtcgagcaggataagaacacacaggaggtgtttgcc
caagtcaaacaaatatacaaaacaccaccccatcaaggattttggaggatttaattctcacaaatactccccgacccatccaagccctc
caaaaggagtttcattgaggacctcttgtttaataaggttaccttggcagatgccgggttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatccctttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttcaaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaaggggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttctaatggaaccattggttcgtgacccaaaggaactttacga
gcctcaaataattacaactgataacattcgtttctggaaattgcgacgtagttataggtattgtaaataatactgtttatgacccttac
aacctgaactcgattccttcaaggaagaactcgacaaatattttaagaatcacacctcaccggacgttgacttaggagacatttccggg
attaacgctagtgtagtcaatatccaaaaggagatagatagactgaatgaggtagcaagaatcttaatgaatctttgatcgaccttca
ggagctggggaagtacgaacaatacataaaatggccatggtacatttggagctcttgcctcttttttcttatcatagggttaa
tcattggactattcttggttctccgagttggtatttatctttgcattaaattaaagcacaccaagaaaagacagatttatacag
acatagagatgaaccgacttggaaagtaaagctcaaatcctgcacaacagattcttcatgtttgaaccaaatcaacttgtgatatc
atgctcaaagaggccttaattaa

From 5' to 3':
    ttcgaaca - BstBI site
    aggagccacc - Kozak sequence (SEQ ID NO: 166)
    atgttcgtgttcctggtgctattacctctggtttcgtctcaatgc - SS (SEQ ID NO: 167)
    tacgaacaatacataaaatggccatggtacatttgg - MPER (SEQ ID NO: 168)
    agctcttgcctcttttttcttatcataggttaatcattggactattcttggttctc - Vector B VSV-G-TM IND serotype (SEQ ID NO: 176)
    cgagttggtatttatctttgcattaaattaaagcacaccaagaaaagacagatttatacagacatagagatgaaccgacttggaaag - Vector B VSV-G-CT IND serotype (SEQ ID NO: 174)
    ttaattaa - PacI site

*Fig. 1L*

Construct 5: S protein with MPER6aa and VSV-G-TM-CT IND serotype (SEQ ID NO: 13)

<u>MFVFLVLLPLVSSQC</u>VNLTTRTQLPPAYTNSFTRGVYYPDKVFRSSVLHSTQDLFLPFFSNVTWFHAIH
VSGTNGTKRFDNPVLPFNDGVYFASTEKSNIIRGWIFGTTLDSKTQSLLIVNNATNVVIKVCEFQFCN
DPFLGVYYHKNNKSWMESEFRVYSSANNCTFEYVSQPFLMDLEGKQGNFKNLREFVFKNIDGYFKIY
SKHTPINLVRDLPQGFSALEPLVDLPIGINITRFQTLLALHRSYLTPGDSSSGWTAGAAAYYVGYLQPR
TFLLKYNENGTITDAVDCALDPLSETKCTLKSFTVEKGIYQTSNFRVQPTESIVRFPNITNLCPFGEVFN
ATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTP
CNGVEGFNCYFPLQSYGFQPTNGVGYQPYRVVVLSFELLHAPATVCGPKKSTNLVKNKCVNFNFNGL
TGTGVLTESNKKFLPFQQFGRDIADTTDAVRDPQTLEILDITPCSFGGVSVITPGTNTSNQVAVLYQD
VNCTEVPVAIHADQLTPTWRVYSTGSNVFQTRAGCLIGAEHVNNSYECDIPIGAGICASYQTQTNSP
RRARSVASQSIIAYTMSLGAENSVAYSNNSIAIPTNFTISVTTEILPVSMTKTSVDCTMYICGDSTECS
NLLLQYGSFCTQLNRALTGIAVEQDKNTQEVFAQVKQIYKTPPIKDFGGFNFSQILPDPSKPSKRSFIE
DLLFNKVTLADAGFIKQYGDCLGDIAARDLICAQKFNGLTVLPPLLTDEMIAQYTSALLAGTITSGWTF
GAGAALQIPFAMQMAYRFNGIGVTQNVLYENQKLIANQFNSAIGKIQDSLSSTASALGKLQDVVNQN
AQALNTLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAHFP
REGVFVSNGTHWFVTQRNFYEPQIITTDNTFVSGNCDVVIGIVNNTVYDPLQPELDSFKEELDKYFKN
HTSPDVDLGDISGINASVVNIQKEIDRLNEVAKNLNESLIDLQELGKYEQYIK<u>SSIASFFFIIGLIIGLF
LVL</u>RVGIYLCIKLKHTKKRQIYTDIEMNRLGK

From N-terminus to C-terminus:
    <u>MFVFLVLLPLVSSQC</u> – SS (SEQ ID NO: 162)
    YEQYIK – MPER (shorter) (SEQ ID NO: 177)
    <u>SSIASFFFIIGLIIGLFLVL</u> - VECTOR B VSV-G-TM IND serotype (SEQ ID NO: 175)
    RVGIYLCIKLKHTKKRQIYTDIEMNRLGK - VECTOR B VSV-G-CT IND serotype (SEQ ID NO: 173)

*Fig. 1M*

Construct 5: nucleotide sequence of S protein with MPER6aa and VSV-G-TM-CT IND serotype
To be added to Vector A (SEQ ID NO: 14)

<u>ctcgag</u>aggagccaccatgttcgtgttcctggtgctattacctctggtttcgtctcaatgcgtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcaggggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacgggactattacagacgcagtcgattgcgcactggatccactctcag
agacaaagtgcactctaaaatcattcactgtcgagaaaggaatctatcaaacatcaaatttcagggtccagccaactgagagtattgtc
cggttccctaacataactaacttgtgccccttcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttccctgcaatcatatgggtttcaaccaaccaatggagtcggatatcaacca
tatcgtgtcgtcgtcctttccttcgagctgcttcatgcaccagctacagtctgcggacctaagaagagcactaatcttgtcaagaacaaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatcaatttgtgcccagaaattcaatggactgacagtcctgcctcccttattaac
tgatgagatgatagctcagtatacatcagcattgttggctggtacaattacatctggatggacatttggtgccggagcggcattacaaa
tcccttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgacttttgtg
gaaaggggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagtttcgtttctaatggaacccattggttcgt
gacccaaaggaacttttacgagcctcaaataattacaactgataatacattcgtttctggaaattgcgacgtagttataggtattgtaaa
taatactgtttatgacccttacaacctgaactcgattccttcaaggaagaactcgacaaatattttaagaatcacacctcaccggacgtt
gacttaggagacatttccgggattaacgctagtagtcaatatccaaaaggagatagatagactgaatgaggtagcaaagaatctt
aatgaatctttgatcgaccttcaggagctggggaagtacgaacaatacataaaa<u>agctctattgcctcttttttctttatcatagggtt
aatcattggactattcttggttctc</u>**cgagttggtatttatctttgcattaaattaaagcacaccaagaaaagacagatttatac
agacatagagatgaaccgacttggaaag**taaa<u>gctagc</u>

From 5' to 3':
    <u>ctcgag</u> - XhoI site
    aggagccacc - KOZAK sequence (SEQ ID NO: 166)
    atgttcgtgttcctggtgctattacctctggtttcgtctcaatgc - SS (SEQ ID NO: 167)
    tacgaacaatacataaaa - MPER (shorter; SEQ ID NO: 178)
    <u>agctctattgcctcttttttctttatcataggggttaatcattggactattcttggttctc</u> - VECTOR B VSV-G-TM IND
    serotype (SEQ ID NO: 176)
    **cgagttggtatttatctttgcattaaattaaagcacaccaagaaaagacagatttatacagacatagagatga
    accgacttggaaag** - VECTOR B VSV-G-CT IND serotype (SEQ ID NO: 174)
    <u>gctagc</u> - NheI site

*Fig. 1N*

Construct 5: nucleotide sequence of S protein with MPER6aa and VSV-G-TM-CT IND serotype
To be added to Vector B (SEQ ID NO: 15)

<u>ttcgaaca</u>actaatatcctgtcttctctatccctatgaaaaaaactaacagagatcgatctgtttccttgacaccaggagccacc<u>atgtt</u>
<u>cgtgttcctggtgctattacctctggtttcgtctcaatgc</u>gtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataaccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcaggggtttatagttccgcaaataattgtacttttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgttgggtatctgcaacctagaacatttc
tcctaaagtataatgaaaacgggactattacagacgcagtcgattgcgcactggatccactctcagagacaaagtgcactctaaaatc
attcactgtcgagaaggaatctatcaaacatcaaatttcagggtccagccaactgagagtattgtccggttccctaacataactaactt
gtgcccccttcggagaggttttcaatgctactcggttcgccagcgtctacgcatggaacagaaagaggatttcaaactgtcgcagatt
atagcgtcctctataattcagcatcattcagtacatttaaatgctatggtgtcagccccaccaaacttaatgacttatgtttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaactataactatttgtacagact
gtttagaaagtcgaatttgaaacctttgaaagagacatatccaccgagatttaccaggcgggcagcacaccgtgtaatggtgtagaa
ggattcaattgttactttcccctgcaatcatatgggttttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaataccaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaattctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgtttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatcgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaggggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttcaatggaacccattggttcgtgacccaaaggaacttttacga
gcctcaaataattacaactgataatacattcgtttctggaaattgcgacgtagttataggtattgtaaataatactgtttatgaccctttac
aacctgaactcgattccttcaaggaagaactcgacaaatattttaagaatcacacctcaccggacgttgacttaggagacatttccggg
attaacgctagtgtagtcaatatccaaaaggagatagatagactgaatgaggtagcaagaatcttaatgaatctttgatcgaccttca
ggagctggggaagtacgaacaatacataaaa<u>agctctattgcctctttttctttatcatagggttaatcattggactattcttggttct</u>
<u>c</u>cgagttggtatttatctttgcattaaattaaagcacaccaagaaaagacagatttatacagacatagagatgaaccga
cttggaaagtaaagctcaaatcctgcacaacagattcttcatgtttgaaccaaatcaacttgtgatatcatgctcaaagaggcc<u>ttaat</u>
<u>taa</u>

From 5' to 3':
    <u>ttcgaaca</u> - BstBI site
    aggagccacc - KOZAK sequence (SEQ ID NO: 166)
    <u>atgttcgtgttcctggtgctattacctctggtttcgtctcaatgc</u> - SS (SEQ ID NO: 167)
    tacgaacaatacataaaa - MPER6aa (shorter MPER; SEQ ID NO: 178)
    <u>agctctattgcctctttttctttatcatagggttaatcattggactattcttggttctc</u> - VECTOR B VSV-G-TM IND
    serotype (SEQ ID NO: 176)
    cgagttggtatttatctttgcattaaattaaagcacaccaagaaaagacagatttatacagacatagagatga
    accgacttggaaag - VECTOR B VSV-G-CT IND serotype (SEQ ID NO: 174)
    <u>ttaattaa</u> - PacI site

*Fig. 10*

Construct 6: S protein with dCt21 (SEQ ID NO: 16)

<u>MFVFLVLLPLVSSQC</u>VNLTTRTQLPPAYTNSFTRGVYYPDKVFRSSVLHSTQDLFLPFFSNVTWFHAIH
VSGTNGTKRFDNPVLPFNDGVYFASTEKSNIIRGWIFGTTLDSKTQSLLIVNNATNVVIKVCEFQFCN
DPFLGVYYHKNNKSWMESEFRVYSSANNCTFEYVSQPFLMDLEGKQGNFKNLREFVFKNIDGYFKIY
SKHTPINLVRDLPQGFSALEPLVDLPIGINITRFQTLLALHRSYLTPGDSSSGWTAGAAAYYVGYLQPR
TFLLKYNENGTITDAVDCALDPLSETKCTLKSFTVEKGIYQTSNFRVQPTESIVRFPNITNLCPFGEVFN
ATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTP
CNGVEGFNCYFPLQSYGFQPTNGVGYQPYRVVVLSFELLHAPATVCGPKKSTNLVKNKCVNFNFNGL
TGTGVLTESNKKFLPFQQFGRDIADTTDAVRDPQTLEILDITPCSFGGVSVITPGTNTSNQVAVLYQD
VNCTEVPVAIHADQLTPTWRVYSTGSNVFQTRAGCLIGAEHVNNSYECDIPIGAGICASYQTQTNSP
RRARSVASQSIIAYTMSLGAENSVAYSNNSIAIPTNFTISVTTEILPVSMTKTSVDCTMYICGDSTECS
NLLLQYGSFCTQLNRALTGIAVEQDKNTQEVFAQVKQIYKTPPIKDFGGFNFSQILPDPSKPSKRSFIE
DLLFNKVTLADAGFIKQYGDCLGDIAARDLICAQKFNGLTVLPPLLTDEMIAQYTSALLAGTITSGWTF
GAGAALQIPFAMQMAYRFNGIGVTQNVLYENQKLIANQFNSAIGKIQDSLSSTASALGKLQDVVNQN
AQALNTLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAHFP
REGVFVSNGTHWFVTQRNFYEPQIITTDNTFVSGNCDVVIGIVNNTVYDPLQPELDSFKEELDKYFKN
HTSPDVDLGDISGINASVVNIQKEIDRLNEVAKNLNESLIDLQELGKYEQYIKWPWYIW<u>LGFIAGL
IAIVMVTIML</u>CCMTSCCSCLKGCCSCGS

From N-terminus to C-terminus:
    <u>MFVFLVLLPLVSSQC</u> – SS (SEQ ID NO: 162)
    YEQYIKWPWYIW – MPER (SEQ ID NO: 163)
    <u>LGFIAGLIAIVMVTIML</u> – TM (SEQ ID NO: 164)
    CCMTSCCSCLKGCCSCGS - CT21 deletion (SEQ ID NO: 179)

*Fig. 1P*

Construct 6: Nucleotide sequence of S protein with dCt21 to be added Vector A (SEQ ID NO: 17)

ctcgagaggagccaccatgttcgtgttcctggtgctattacctctggtttcgtctcaatgcgtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcagggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacggactattacagacgcagtcgattgcgcactggatccactctcag
agacaaagtgcactctaaaatcattcactgtcgagaaaggaatctatcaaacatcaaatttcagggtccagccaactgagagtattgtc
cggttccctaacataactaacttgtgccccttcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttcccctgcaatcatatgggtttcaaccaaccaatggagtcggatatcaacca
tatcgtgtcgtcgtcctttccttcgagctgcttcatgcaccagctacagtctgcggacctaagaagagcactaatcttgtcaagaacaaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatctaatttgtgcccagaaattcaatggactgacagtcctgcctcccttattaac
tgatgagatgatagctcagtatacatcagcattgttggctggtacaattacatctggatggacatttggtgccggagcggcattacaaa
tccctttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgacttttgtg
gaaaggggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagttttcgtttctaatggaacccattggttcgt
gacccaaaggaacttttacgagcctcaaataattacaactgataatacattcgtttctggaaattgcgacgtagttataggtattgtaaa
taatactgtttatgaccctttacaacctgaactcgattccttcaaggaagaactcgacaaatatttaagaatcacacctcaccggacgtt
gacttaggagacatttccgggattaacgctagtgtagtcaatatccaaaaggagatagatagactgaatgaggtagcaaagaatctt
aatgaatctttgatcgaccttcaggagctggggaagtacgaacaatacataaaatggccatggtacatttggctcgggtttattg
ctggactaattgcaatagtcatggtcactatcatgctg**tgttgtatgacatcgtgctgctcatgcctcaagggatgttgtagctg
tggatct**taaaggctagc From 5′ to 3′:

ctcgag - XhoI site
aggagccacc - KOZAK sequence (SEQ ID NO: 166)
atgttcgtgttcctggtgctattacctctggtttcgtctcaatgc - SS (SEQ ID NO: 167)
tacgaacaatacataaaatggccatggtacatttgg - MPER (SEQ ID NO: 168)
ctcgggtttattgctggactaattgcaatagtcatggtcactatcatgctg - TM (SEQ ID NO: 169)
tgttgtatgacatcgtgctgctcatgcctcaagggatgttgtagctgtggatct - CT21 deletion (SEQ ID NO: 180)
gctagc - NheI site

Fig. 1Q

Construct 6: Nucleotide sequence of S protein with dCt21 to be added Vector B (SEQ ID NO: 18)

ttcgaacaactaatatcctgtcttctctatccctatgaaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataacccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtacttttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgttgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttccctaacataactaactt
gtgccccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaactataactatttgtacagact
gtttagaaagtcgaatttgaaaccttttgaaagagacatatccaccgagatttaccaggcgggcagcacaccgtgtaatggtgtagaa
ggattcaattgttactttcccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaatacctaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaatttctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaaggggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttctaatggaacccattggttcgtgacccaaaggaacttttacga
gcctcaaataattacaactgataatacattcgtttctggaaattgcgacgtagttataggtattgtaaataatactgtttatgacccttac
aacctgaactcgattccttcaaggaagaactcgacaaatattttaagaatcacacctcaccggacgttgacttaggagacatttccggg
attaacgctagtgtagtcaatatccaaaaggagatagatagactgaatgaggtagcaaagaatcttaatgaatctttgatcgaccttca
ggagctggggaagtacgaacaatacataaaatggccatggtacatttggctcgggtttattgctggactaattgcaatagtcat
ggtcactatcatgctgtgttgtatgacatcgtgctgctcatgcctcaagggatgttgtagctgtggatcttaaagctcaaatcct
gcacaacagattcttcatgtttgaaccaaatcaacttgtgatatcatgctcaaagaggccttaattaa From 5′ to 3′:

- ttcgaaca - BstBI site
- aggagccacc - KOZAK sequence (SEQ ID NO: 166)
- atgttcgtgttcctggtgctattacctctggtttcgtctcaatgc - SS (SEQ ID NO: 167)
- tacgaacaatacataaaatggccatggtacatttgg - MPER (SEQ ID NO: 168)
- ctcgggtttattgctggactaattgcaatagtcatggtcactatcatgctg - TM (SEQ ID NO: 169)
- tgttgtatgacatcgtgctgctcatgcctcaagggatgttgtagctgtggatct - CT21 deletion (SEQ ID NO: 180)
- ttaattaa - PacI site

*Fig. 1R*

Construct 7: S protein with dCt19 and VSV-Gct (SEQ ID NO: 19)

MFVFLVLLPLVSSQCVNLTTRTQLPPAYTNSFTRGVYYPDKVFRSSVLHSTQDLFLPFFSN
VTWFHAIHVSGTNGTKRFDNPVLPFNDGVYFASTEKSNIIRGWIFGTTLDSKTQSLLIVN
NATNVVIKVCEFQFCNDPFLGVYYHKNNKSWMESEFRVYSSANNCTFEYVSQPFLMDLE
GKQGNFKNLREFVFKNIDGYFKIYSKHTPINLVRDLPQGFSALEPLVDLPIGINITRFQTLL
ALHRSYLTPGDSSSGWTAGAAAYYVGYLQPRTFLLKYNENGTITDAVDCALDPLSETKC
TLKSFTVEKGIYQTSNFRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADYN
YKLPDDFTGCVIAWNSNNLDSKVGGNYNYLYRLFRKSNLKPFERDISTEIYQAGSTPCN
GVEGFNCYFPLQSYGFQPTNGVGYQPYRVVVLSFELLHAPATVCGPKKSTNLVKNKCVN
FNFNGLTGTGVLTESNKKFLPFQQFGRDIADTTDAVRDPQTLEILDITPCSFGGVSVITP
GTNTSNQVAVLYQDVNCTEVPVAIHADQLTPTWRVYSTGSNVFQTRAGCLIGAEHVNN
SYECDIPIGAGICASYQTQTNSPRRARSVASQSIIAYTMSLGAENSVAYSNNSIAIPTNFT
ISVTTEILPVSMTKTSVDCTMYICGDSTECSNLLLQYGSFCTQLNRALTGIAVEQDKNTQ
EVFAQVKQIYKTPPIKDFGGFNFSQILPDPSKPSKRSFIEDLLFNKVTLADAGFIKQYGDC
LGDIAARDLICAQKFNGLTVLPPLLTDEMIAQYTSALLAGTITSGWTFGAGAALQIPFAM
QMAYRFNGIGVTQNVLYENQKLIANQFNSAIGKIQDSLSSTASALGKLQDVVNQNAQAL
NTLVKQLSSNFGAISSVLNDILSRLDKVEAEVQIDRLITGRLQSLQTYVTQQLIRAAEIRA
SANLAATKMSECVLGQSKRVDFCGKGYHLMSFPQSAPHGVVFLHVTYVPAQEKNFTTA
PAICHDGKAHFPREGVFVSNGTHWFVTQRNFYEPQIITTDNTFVSGNCDVVIGIVNNTV
YDPLQPELDSFKEELDKYFKNHTSPDVDLGDISGINASVVNIQKEIDRLNEVAKNLNESL
IDLQELGKYEQYIKWPWYIWLGFIAGLIAIVMVTIMLCCMTSCCSCLKGCCSCGSCC
RVGIYLCIKLKHTKKRQIYTDIEMNRLGK

From N-terminus to C-terminus:

MFVFLVLLPLVSSQC – SS (SEQ ID NO: 162)
YEQYIK – MPER (SEQ ID NO: 177)
WPWYIWLGFIAGLIAIVMVTIML – TM (SEQ ID NO: 181)
CCMTSCCSCLKGCCSCGSCC - CT19 deletion (SEQ ID NO: 182)
RVGIYLCIKLKHTKKRQIYTDIEMNRLGK - VECTOR B VSV-G-CT IND serotype (SEQ ID NO: 173)

*Fig. 1S*

Construct 7: Nucleotide sequence of S protein with dCt19 and VSGct to be added Vector A (SEQ ID NO: 20)

ctcgagaggagccaccatgttcgtgttcctggtgctattacctctggtttcgtctcaatgcgtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcagggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaagggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacggactattacagacgcagtcgattgcgcactggatccactctcag
agacaaagtgcactctaaaatcattcactgtcgagaaaggaatctatcaaacatcaaatttcagggtccagccaactgagagtattgtc
cggttccctaacataactaacttgtgccccttcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttcccctgcaatcatatgggtttcaaccaaccaatggagtcggatatcaacca
tatcgtgtcgtcgtcctttccttcgagctgcttcatgcaccagctacagtctgcggacctaagaagagcactaatcttgtcaagaacaaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatctaatttgtgcccagaaattcaatggactgacagtcctgcctcccttattaac
tgatgagatgatagctcagtatacatcagcattgttggctggtacaattacatctggatggacatttggtgccggagcggcattacaaa
tcccttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgacttttgtg
gaaaggggtatcacttgatgtcctttcctcaatctgcaccacacggagttgtcttcttacatgtaacatatgtgcccgctcaagaaaaga
atttcactacagcacctgcaatatgtcatgacggaaaagcacattttcctcgggagggagttttcgtttctaatggaacccattggttcgt
gacccaaaggaacttttacgagcctcaaataattacaactgataatacattcgtttctggaaattgcgacgtagttataggtattgtaaa
taatactgtttatgacccttacaacctgaactcgattccttcaaggaagaactcgacaaatatttaagaatcacacctcaccggacgtt
gacttaggagacatttccgggattaacgctagtgtagtcaatatccaaaaggagatagatagactgaatgaggtagcaaagaatctt
aatgaatctttgatcgaccttcaggagctggggaagtacgaacaatacataaaatggccatggtacatttggctcggtttattg
ctggactaattgcaatagtcatggtcactatcatgctgtgttgtatgacatcgtgctgctcatgcctcaagggatgttgtagctgtg
gatcttgttgccgagttggtatttatctttgcattaaattaaagcacaccaagaaaagacagatttatacagacatagaga
tgaaccgacttggaaagtaaaggctagc From 5′ to 3′:

ctcgag - XhoI site
aggagccacc - KOZAK sequence (SEQ ID NO: 166)
atgttcgtgttcctggtgctattacctctggtttcgtctcaatgc - SS (SEQ ID NO: 167)
tacgaacaatacataaaa – MPER (SEQ ID NO: 192)
tggccatggtacatttggctcggtttattgctggactaattgcaatagtcatggtcactatcatgctg – TM (SEQ ID NO: 183)
tgttgtatgacatcgtgctgctcatgcctcaagggatgttgtagctgtggatcttgttgc - CT19 deletion (SEQ ID NO: 184)
cgagttggtatttatctttgcattaaattaaagcacaccaagaaaagacagatttatacagacatagagatgaaccgacttggaaag - VECTOR B VSV-G-CT IND serotype (SEQ ID NO: 174)
gctagc - NheI site

*Fig. 1T*

Construct 7: Nucleotide sequence of S protein with dCt19 and VSGct to be added Vector B (SEQ ID NO: 21)

<u>ttcgaaca</u>actaatatcctgtcttctctatccctatgaaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataacccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtacttttgaatacgtttcccaaccattcttaatggacttggagggaaaacagggaaa
ttttaagaatctaagagaattcgtcttttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgtgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttcctaacataactaactt
gtgcccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaaactataactatttgtacagact
gtttagaaagtcgaatttgaaacctttgaaagagacatatccaccgagatttaccaggcgggcagcacaccgtgtaatggtgtagaa
ggattcaattgttactttccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcacccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaataccctaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaatttctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaaggggtatcacttgatgt
cctttcctcaatctgcaccacacggagttgtcttcttacatgtaacatatgtgcccgctcaagaaaagaatttcactacagcacctgcaat
atgtcatgacggaaaagcacatttcctcgggagggagttttcgtttctaatggaacccattggttcgtacccaaaggaactttacga
gcctcaaataattacaactgataatacattcgtttctggaaattgcgacgtagttataggtattgtaaataatactgtttatgacccttttac
aacctgaactcgattccttcaaggaagaactcgacaaatattttaagaatcacacctcaccggacgttgacttaggagacatttccggg
attaacgctagtgtagtcaatatccaaaaggagatagatagactgaatgagggtagcaaagaatcttaatgaatctttgatcgaccttca
ggagctggggaagtacgaacaatacataaaa**tggccatggtacatttggctcgggtttattgctggactaattgcaatagtc
atggtcactatcatgctgtgttgtatgacatcgtgctgctcatgcctcaagggatgttgagctgtggatcttgttgccgagttggta
tttatctttgcattaaattaaagcacaccaagaaaagacagatttatacagacatagagatgaaccgacttggaaag**ta
aagctcaaatcctgcacaacagattcttcatgtttgaaccaaatcaacttgtgatatcatgctcaaagaggcc<u>ttaattaa</u>

From 5' to 3':
 <u>ttcgaaca</u> - BstBI site
 aggagccacc - KOZAK sequence (SEQ ID NO: 166)
 <u>atgttcgtgttcctggtgctattacctctggtttcgtctcaatgc</u> - SS (SEQ ID NO: 167)
 tggccatggtacatttggctcgggtttattgctggactaattgcaatagtcatggtcactatcatgctg – TM (SEQ ID NO: 183)
 <u>tgttgtatgacatcgtgctgctcatgcctcaagggatgttgagctgtggatcttgttgc</u> - CT19 deletion (SEQ ID NO: 184)
 cgagttggtatttatctttgcattaaattaaagcacaccaagaaaagacagatttatacagacatagagatgaaccgacttggaaag - VECTOR B VSV-G-CT IND serotype (SEQ ID NO: 174)
 <u>ttaattaa</u> - PacI site

*Fig. 1U*

Construct 8: S protein with dCt19 and VSV-Gct21 (SEQ ID NO: 22)

MFVFLVLLPLVSSQCVNLTTRTQLPPAYTNSFTRGVYYPDKVFRSSVLHSTQDLFLPFFSN
VTWFHAIHVSGTNGTKRFDNPVLPFNDGVYFASTEKSNIIRGWIFGTTLDSKTQSLLIVN
NATNVVIKVCEFQFCNDPFLGVYYHKNNKSWMESEFRVYSSANNCTFEYVSQPFLMDLE
GKQGNFKNLREFVFKNIDGYFKIYSKHTPINLVRDLPQGFSALEPLVDLPIGINITRFQTLL
ALHRSYLTPGDSSSGWTAGAAAYYVGYLQPRTFLLKYNENGTITDAVDCALDPLSETKC
TLKSFTVEKGIYQTSNFRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADYN
YKLPDDFTGCVIAWNSNNLDSKVGGNYNYLYRLFRKSNLKPFERDISTEIYQAGSTPCN
GVEGFNCYFPLQSYGFQPTNGVGYQPYRVVVLSFELLHAPATVCGPKKSTNLVKNKCVN
FNFNGLTGTGVLTESNKKFLPFQQFGRDIADTTDAVRDPQTLEILDITPCSFGGVSVITP
GTNTSNQVAVLYQDVNCTEVPVAIHADQLTPTWRVYSTGSNVFQTRAGCLIGAEHVNN
SYECDIPIGAGICASYQTQTNSPRRARSVASQSIIAYTMSLGAENSVAYSNNSIAIPTNFT
ISVTTEILPVSMTKTSVDCTMYICGDSTECSNLLLQYGSFCTQLNRALTGIAVEQDKNTQ
EVFAQVKQIYKTPPIKDFGGFNFSQILPDPSKPSKRSFIEDLLFNKVTLADAGFIKQYGDC
LGDIAARDLICAQKFNGLTVLPPLLTDEMIAQYTSALLAGTITSGWTFGAGAALQIPFAM
QMAYRFNGIGVTQNVLYENQKLIANQFNSAIGKIQDSLSSTASALGKLQDVVNQNAQAL
NTLVKQLSSNFGAISSVLNDILSRLDKVEAEVQIDRLITGRLQSLQTYVTQQLIRAAEIRA
SANLAATKMSECVLGQSKRVDFCGKGYHLMSFPQSAPHGVVFLHVTYVPAQEKNFTTA
PAICHDGKAHFPREGVFVSNGTHWFVTQRNFYEPQIITTDNTFVSGNCDVVIGIVNNTV
YDPLQPELDSFKEELDKYFKNHTSPDVDLGDISGINASVVNIQKEIDRLNEVAKNLNESL
IDLQELGKYEQYIKWPWYIWLGFIAGLIAIVMVTIMLCCMTSCCSCLKGCCSCGSCC
KLKHTKKRQIYTDIEMNRLGK

From N-terminus to C-terminus:
    MFVFLVLLPLVSSQC – SS (SEQ ID NO: 162)
    YEQYIK – MPER (SEQ ID NO: 177)
    WPWYIWLGFIAGLIAIVMVTIML – TM (SEQ ID NO: 181)
    CCMTSCCSCLKGCCSCGSCC - CT19 deletion (SEQ ID NO: 182)
    KLKHTKKRQIYTDIEMNRLGK - VECTOR B VSV-G-CT IND serotype (SEQ ID NO: 185)

*Fig. 1V*

Construct 8: Nucleotide sequence of S protein with dCt19 and VSGct21 to be added Vector A (SEQ ID NO: 23)

<u>ctcgagaggagccacc</u>atgttcgtgttcctggtgctattacctctggtttcgtctcaatgcgtaaaccttacaactagaactcagcttcct
ccagcatacacaaattccttcactcgcggagtgtattatcctgataaggtctttcgatcatcagtgttgcattccacccaggatttgtttctc
ccgttcttttcaaatgtaacttggttccatgctatacatgtttccggaaccaatggaacaaagagatttgataacccagtgttaccatttaa
cgacggagtttatttcgcatcaactgagaaatccaatatcattagaggctggattttcggaacgaccctggattctaaaacgcaatcctt
gctgattgttaataatgcaacaaatgtggtcattaaagtctgtgaattccaattttgcaatgatccatttctcggcgtctattaccacaaga
ataacaaatcttggatggagtcagagttcagggtttatagttccgcaaataattgtacttttgaatacgtttcccaaccattcttaatggac
ttggagggaaaacagggaaattttaagaatctaagagaattcgtctttaagaatattgatggatatttcaagatctattcaaaacatac
acctataaacctagttagagatctcccgcaaggggttttcagccctagagccactagttgacctgccaattgggatcaacattactagatt
ccagaccctactcgctctgcatcggtcatatttgacaccaggagattcatcgtcaggatggaccgctggagcagctgcttactatgttgg
gtatctgcaacctagaacatttctcctaaagtataatgaaaacgggactattacagacgcagtcgattgcgcactggatccactctcag
agacaaagtgcactctaaaatcattcactgtcgagaaaggaatctatcaaacatcaaatttcagggtccagccaactgagagtattgtc
cggttccctaacataactaacttgtgcccctcggagaggttttcaatgctactcggttcgccagcgtctacgcatggaacagaaagag
gatttcaaactgtgtcgcagattatagcgtcctctataattcagcatcattcagtacatttaaatgctatggtgtcagccccaccaaactta
atgacttatgttttaccaatgtatatgcagattcctttgtaatcagaggtgacgaagtgaggcaaatcgcacctggacagaccggaaag
attgctgattataattataaactccctgatgattttaccggatgtgttattgcttggaacagcaataacctcgatagtaaggtcggaggaa
actataactatttgtacagactgtttagaaagtcgaatttgaaaccttttgaaagagacatatccaccgagatttaccaggcgggcagc
acaccgtgtaatggtgtagaaggattcaattgttactttcccctgcaatcatatgggtttcaaccaaccaatggagtcggatatcaacca
tatcgtgtcgtcgtcctttccttcgagctgcttcatgcaccagctacagtctgcggacctaagaagagcactaatcttgtcaagaacaat
gtgtgaactttaattttaatggattaacaggaaccggagttttgaccgagagtaataagaagttcttgccgttccagcaatttggacgag
acattgctgacaccacagatgcggttcgtgacccgcaaactttagagatcctagacatcaccccatgttcattcggtggagtttccgttat
tactcctggaacgaatacaagcaatcaagttgccgttctctatcaagatgttaattgtacagaagtgcctgtggccattcatgcagatca
actaacaccaacttggagagtttacagcactgggtccaatgtcttccaaacgcgcgccggctgcctcattggtgcagaacatgtgaata
actcatacgaatgtgacattccaatcggtgccggcatatgcgcctcttaccagactcagactaattcgccaagaagagccaggtctgtc
gcaagtcagtcaattattgcatacacaatgtcgttaggagcagagaatagtgtagcatactcaaacaattctatagcaatacctaccaa
cttcactatatcagtaactacagaaatattgccagtatccatgactaaaacaagtgtggattgcaccatgtacatctgtggagattccac
agaatgcagcaatcttctcttgcaatacggatcattctgcacacaactgaatagggcactgactggaattgcagtcgagcaggataag
aacacacaggaggtgtttgcccaagtcaaacaaatatacaaaacaccacccatcaaggattttggaggatttaatttctcacaaatact
ccccgacccatccaagccctccaaaaggagtttcattgaggacctcttgtttaataaggttaccttggcagatgccgggtttattaagca
gtacggcgactgtcttggagacatagcagccagagatctaatttgtgcccagaaattcaatggactgacagtcctgcctcccttattaac
tgatgagatgatagctcagtatacatcagcattgttggctggtacaattacatctggatggacatttggtgccggagcggcattacaaa
tcccttttgcaatgcaaatggcctatagatttaatggaatcggagtaactcaaaatgttttatatgagaatcagaaattaattgcaaatca
attcaattcagctataggaaagattcaggattcactcagtagtacagcaagcgctctaggcaaattacaagacgtcgtcaatcagaat
gcacaggcattaaatacactggtgaagcaattgagttccaatttcggagcaatttcatctgttctaaatgatatattgtcaagactggat
aaagtagaagccgaggtccaaatcgataggctgatcacaggaagacttcaatcactacagacatacgtcacccaacaactcatcaga
gcagcagaaattagagcctctgctaatctagccgcaacaaagatgtcagagtgcgtattgggacaatctaagagggtcgactttgtg
gaaagggtatcacttgatgtcctttcctcaatctgcaccacacggagttgtcttcttacatgtaacatatgtgcccgctcaagaaaaga
atttcactacagcacctgcaatgtcatgacggaaaagcacattttcctcgggagggagttttcgtttctaatggaacccattggttcgt
gacccaaaggaacttttacgagcctcaaataattacaactgataatacattcgtttctggaaattgcgacgtagttataggtattgtaaa
taatactgtttatgacccttacaacctgaactcgattccttcaaggaagaactcgacaaatattttaagaatcacacctcaccggacgtt
gacttaggagacatttccgggattaacgctagtgtagtcaatatccaaaaggagatagatagactgaatgaggtagcaagaatctt
aatgaatctttgatcgaccttcaggagctggggaagtacgaacaatacataaaa**tggccatggtacatttggctcgggtttattg
ctggactaattgcaatagtcatggtcactatcatgctg**tgttgtatgacatcgtgctgctcatgcctcaaggga<u>tgttgtagctgtg
gatcttgttgc</u>**aaattaaagcacaccaagaaaagacagatttatacagacatagagatgaa Construct 8: Nucleotide sequence of S protein with dCt19 and VSGct21 to be added Vector B (SEQ ID NO: 24)

ttcgaacaactaatatcctgtcttctctatccctatgaaaaaactaacagagatcgatctgtttccttgacaccaggagccaccatgtt
cgtgttcctggtgctattacctctggtttcgtctcaatgcgtaaaccttacaactagaactcagcttcctccagcatacacaaattccttcac
tcgcggagtgtattatcctgataaggtctttcgatcatcagtgttgcattccacccaggatttgtttctcccgttcttttcaaatgtaacttgg
ttccatgctatacatgtttccggaaccaatggaacaaagagatttgataacccagtgttaccatttaacgacggagtttatttcgcatcaa
ctgagaaatccaatatcattagaggctggattttcggaacgaccctggattctaaaacgcaatccttgctgattgttaataatgcaacaa
atgtggtcattaaagtctgtgaattccaattttgcaatgatccatttctcggcgtctattaccacaagaataacaaatcttggatggagtc
agagttcagggtttatagttccgcaaataattgtacttttgaatacgtttcccaaccattcttaatggacttggagggaaaacagggaaa
ttttaagaatctaagagaattcgtctttaagaatattgatggatatttcaagatctattcaaaacatacacctataaacctagttagagat
ctcccgcaagggttttcagccctagagccactagttgacctgccaattgggatcaacattactagattccagaccctactcgctctgcatc
ggtcatatttgacaccaggagattcatcgtcaggatggaccgctggagcagctgcttactatgttgggtatctgcaacctagaacatttc
tcctaaagtataatgaaaacgggactattacagacgcagtcgattgcgcactggatccactctcagagacaaagtgcactctaaaatc
attcactgtcgagaaaggaatctatcaaacatcaaatttcagggtccagccaactgagagtattgtccggttccctaacataactaactt
gtgccccttcggagaggttttcaatgctactcggttcgccagcgtctacgcatggaacagaaagaggatttcaaactgtgtcgcagatt
atagcgtcctctataattcagcatcattcagtacatttaaatgctatggtgtcagccccaccaaacttaatgacttatgttttaccaatgtat
atgcagattcctttgtaatcagaggtgacgaagtgaggcaaatcgcacctggacagaccggaaagattgctgattataattataaact
ccctgatgattttaccggatgtgttattgcttggaacagcaataacctcgatagtaaggtcggaggaaactataactatttgtacagact
gtttagaaagtcgaatttgaaaccttttgaaagagacatatccaccgagatttaccaggcgggcagcacaccgtgtaatggtgtagaa
ggattcaattgttactttcccctgcaatcatatgggtttcaaccaaccaatggagtcggatatcaaccatatcgtgtcgtcgtcctttccttc
gagctgcttcatgcaccagctacagtctgcggacctaagaagagcactaatcttgtcaagaacaaatgtgtgaactttaattttaatgg
attaacaggaaccggagttttgaccgagagtaataagaagttcttgccgttccagcaatttggacgagacattgctgacaccacagat
gcggttcgtgacccgcaaactttagagatcctagacatcaccccatgttcattcggtggagtttccgttattactcctggaacgaatacaa
gcaatcaagttgccgttctctatcaagatgttaattgtacagaagtgcctgtggccattcatgcagatcaactaacaccaacttggagag
tttacagcactgggtccaatgtcttccaaacgcgcgccggctgcctcattggtgcagaacatgtgaataactcatacgaatgtgacattc
caatcggtgccggcatatgcgcctcttaccagactcagactaattcgccaagaagagccaggtctgtcgcaagtcagtcaattattgca
tacacaatgtcgttaggagcagagaatagtgtagcatactcaaacaattctatagcaatacctaccaacttcactatatcagtaactaca
gaaatattgccagtatccatgactaaaacaagtgtggattgcaccatgtacatctgtggagattccacagaatgcagcaatcttctcttg
caatacggatcattctgcacacaactgaatagggcactgactggaattgcagtcgagcaggataagaacacacaggaggtgtttgcc
caagtcaaacaaatatacaaaacaccacccatcaaggattttggaggatttaatttctcacaaatactccccgacccatccaagccctc
caaaaggagtttcattgaggacctcttgtttaataaggttaccttggcagatgccgggtttattaagcagtacggcgactgtcttggaga
catagcagccagagatctaatttgtgcccagaaattcaatggactgacagtcctgcctcccttattaactgatgagatgatagctcagta
tacatcagcattgttggctggtacaattacatctggatggacatttggtgccggagcggcattacaaatcccttttgcaatgcaaatggc
ctatagatttaatggaatcggagtaactcaaaatgttttatatgagaatcagaaattaattgcaaatcaattcaattcagctataggaaa
gattcaggattcactcagtagtacagcaagcgctctaggcaaattacaagacgtcgtcaatcagaatgcacaggcattaaatacactg
gtgaagcaattgagttccaatttcggagcaatttcatctgttctaaatgatatattgtcaagactggataaagtagaagccgaggtcca
aatcgataggctgatcacaggaagacttcaatcactacagacatacgtcacccaacaactcatcagagcagcagaaattagagcctct
gctaatctagccgcaacaaagatgtcagagtgcgtattgggacaatctaagagggtcgacttttgtggaaaggggtatcacttgatgt
cctttcctcaatctgcaccacacggagttgtcttcttacatgtaacatatgtgcccgctcaagaaaagaatttcactacagcacctgcaat
atgtcatgacggaaaagcacattttcctcgggagggagttttcgtttctaatggaacccattggttcgtgacccaaaggaacttttacga
gcctcaaataattacaactgataatacattcgtttctggaaattgcgacgtagttataggtattgtaaataatactgtttatgaccctttac
aacctgaactcgattccttcaaggaagaactcgacaaatattttaagaatcacacctcaccggacgttgacttaggagacatttccggg
attaacgctagtgtagtcaatatccaaaaggagatagatagactgaatgaggtagcaaagaatcttaatgaatctttgatcgaccttca
ggagctggggaagtacgaacaatacataaaatggccatggtacatttggctcgggtttattgctggactaattgcaatagtc
atggtcactatcatgctgtgttgtatgacatcgtgctgctcatgcctcaagggatgttgtagctgtggatcttgttgcaaattaaagc
acaccaagaaaagacagatttatacagacatagagatgaaccgacttggaaagtaaagctcaaatcctgcacaacagatt
cttcatgtttgaaccaaatcaacttgtgatatcatgctcaaagaggccttaattaa From 5′ to 3′:

ttcgaaca - BstBI site
aggagccacc - KOZAK sequence (SEQ ID NO: 166)
atgttcgtgttcctggtgctattacctctggtttcgtctcaatgc - SS (SEQ ID NO: 167)
tggccatggtacatttggctcgggtttattgctggactaattgcaatagtcatggtcactatcatgctg – TM (SEQ ID NO: 183)
tgttgtatgacatcgtgctgctcatgcctcaagggatgttgtagctgtggatcttgttgc - CT19 deletion (SEQ ID NO: 184)
aaattaaagcacaccaagaaaagacagatttatacagacatagagatgaaccgacttggaaag - VECTOR B VSV-G-CT IND serotype (SEQ ID NO: 186)
ttaattaa - PacI site

Fig. 1X

```
                         1          10         20         30         40
Vector A VSV-G-TM-CT SSIASFFFII GLIIGLFLVL RVGIHLCIKL KHTKKRQIYT
SEQ ID NO: 187

Vector B VSV-G-TM-CT SSIASFFFII GLIIGLFLVL RVGIYLCIKL KHTKKRQIYT
SEQ ID NO: 188

51      59
Vector A VSV-G-TM-CT DIEMNRLGK
SEQ ID NO: 187 (Cont.)

Vector B VSV-G-TM-CT DIEMNRLGK
SEQ ID NO: 188 (Cont.)
```

```
gb_QHO62107      61  NVTWFHAIHVSGTNGTKRFDNPVLPFNDGVYFASTEKSNIIRGWIFGTTLDSKTQSLLIV  (SEQ ID NO: 54)
gb_QHQ82464      61  NVTWFHAIHVSGTNGTKRFDNPVLPFNDGVYFASTEKSNIIRGWIFGTTLDSKTQSLLIV  (SEQ ID NO: 55)
dbj_BBW89517     61  NVTWFHAIHVSGTNGTKRFDNPVLPFNDGVYFASTEKSNIIRGWIFGTTLDSKTQSLLIV  (SEQ ID NO: 56)
gb_QHU79204      61  NVTWFHAIHVSGTNGTKRFDNPVLPFNDGVYFASTEKSNIIRGWIFGTTLDSKTQSLLIV  (SEQ ID NO: 57)
gb_QHQ71963      61  NVTWFHAIHVSGTNGTKRFDNPVLPFNDGVYFASTEKSNIIRGWIFGTTLDSKTQSLLIV  (SEQ ID NO: 58)
gb_QHU79194      61  NVTWFHAIHVSGTNGTKRFDNPVLPFNDGVYFASTEKSNIIRGWIFGTTLDSKTQSLLIV  (SEQ ID NO: 59)
gb_QHN73795      61  NVTWFHAIHVSGTNGTKRFDNPVLPFNDGVYFASTEKSNIIRGWIFGTTLDSKTQSLLIV  (SEQ ID NO: 60)
gb_QHU36864      61  NVTWFHAIHVSGTNGTKRFDNPVLPFNDGVYFASTEKSNIIRGWIFGTTLDSKTQSLLIV  (SEQ ID NO: 61)
gb_QHD43416      61  NVTWFHAIHVSGTNGTKRFDNPVLPFNDGVYFASTEKSNIIRGWIFGTTLDSKTQSLLIV  (SEQ ID NO: 62)
gb_QHU36854      61  NVTWFHAIHVSGTNGTKRFDNPVLPFNDGVYFASTEKSNIIRGWIFGTTLDSKTQSLLIV  (SEQ ID NO: 63)
gb_QHU36844      61  NVTWFHAIHVSGTNGTKRFDNPVLPFNDGVYFASTEKSNIIRGWIFGTTLDSKTQSLLIV  (SEQ ID NO: 64)
gb_QHU36834      61  NVTWFHAIHVSGTNGTKRFDNPVLPFNDGVYFASTEKSNIIRGWIFGTTLDSKTQSLLIV  (SEQ ID NO: 65)
gb_QHU36824      61  NVTWFHAIHVSGTNGTKRFDNPVLPFNDGVYFASTEKSNIIRGWIFGTTLDSKTQSLLIV  (SEQ ID NO: 66)
consensus        61  NVTWFHAIHVSGTNGTKRFDNPVLPFNDGVYFASTEKSNIIRGWIFGTTLDSKTQSLLIV  (SEQ ID NO: 67)

gb_QHW06059     121  NNATNVVIKVCEFQFCNDPFLGVYYHKNNKSWMESEFRVYSSANNCTFEYVSQPFLMDLE  (SEQ ID NO: 25)
gb_QHZ00379     121  NNATNVVIKVCEFQFCNDPFLGVYYHKNNKSWMESEFRVYSSANNCTFEYVSQPFLMDLE  (SEQ ID NO: 26)
gb_QHR84449     121  NNATNVVIKVCEFQFCNDPFLGVYYHKNNKSWMESEFRVYSSANNCTFEYVSQPFLMDLE  (SEQ ID NO: 27)
gb_QIA20044     121  NNATNVVIKVCEFQFCNDPFLGVYYHKNNKSWMESEFRVYSSANNCTFEYVSQPFLMDLE  (SEQ ID NO: 28)
gb_QHZ00358     121  NNATNVVIKVCEFQFCNDPFLGVYYHKNNKSWMESEFRVYSSANNCTFEYVSQPFLMDLE  (SEQ ID NO: 29)
dbj_BCA25664    121  NNATNVVIKVCEFQFCNDPFLGVYYHKNNKSWMESEFRVYSSANNCTFEYVSQPFLMDLE  (SEQ ID NO: 30)
gb_QHZ87582     121  NNATNVVIKVCEFQFCNDPFLGVYYHKNNKSWMESEFRVYSSANNCTFEYVSQPFLMDLE  (SEQ ID NO: 31)
dbj_BCA25674    121  NNATNVVIKVCEFQFCNDPFLGVYYHKNNKSWMESEFRVYSSANNCTFEYVSQPFLMDLE  (SEQ ID NO: 32)
gb_QHZ00389     121  NNATNVVIKVCEFQFCNDPFLGVYYHKNNKSWMESEFRVYSSANNCTFEYVSQPFLMDLE  (SEQ ID NO: 33)
gb_QHZ87592     121  NNATNVVIKVCEFQFCNDPFLGVYYHKNNKSWMESEFRVYSSANNCTFEYVSQPFLMDLE  (SEQ ID NO: 34)
gb_QIB84673     121  NNATNVVIKVCEFQFCNDPFLGVYYHKNNKSWMESEFRVYSSANNCTFEYVSQPFLMDLE  (SEQ ID NO: 35)
gb_QHR63260     121  NNATNVVIKVCEFQFCNDPFLGVYYHKNNKSWMESEFRVYSSANNCTFEYVSQPFLMDLE  (SEQ ID NO: 36)
gb_QIA98606     121  NNATNVVIKVCEFQFCNDPFLGVYYHKNNKSWMESEFRVYSSANNCTFEYVSQPFLMDLE  (SEQ ID NO: 37)
gb_QIA98596     121  NNATNVVIKVCEFQFCNDPFLGVYYHKNNKSWMESEFRVYSSANNCTFEYVSQPFLMDLE  (SEQ ID NO: 38)
gb_QHR63250     121  NNATNVVIKVCEFQFCNDPFLGVYYHKNNKSWMESEFRVYSSANNCTFEYVSQPFLMDLE  (SEQ ID NO: 39)
gb_QHR63280     121  NNATNVVIKVCEFQFCNDPFLGVYYHKNNKSWMESEFRVYSSANNCTFEYVSQPFLMDLE  (SEQ ID NO: 40)
gb_QHR63290     121  NNATNVVIKVCEFQFCNDPFLGVYYHKNNKSWMESEFRVYSSANNCTFEYVSQPFLMDLE  (SEQ ID NO: 41)
gb_QHR63270     121  NNATNVVIKVCEFQFCNDPFLGVYYHKNNKSWMESEFRVYSSANNCTFEYVSQPFLMDLE  (SEQ ID NO: 42)
gb_QHZ00399     121  NNATNVVIKVCEFQFCNDPFLGVYYHKNNKSWMESEFRVYSSANNCTFEYVSQPFLMDLE  (SEQ ID NO: 43)
dbj_BCA25644    121  NNATNVVIKVCEFQFCNDPFLGVYYHKNNKSWMESEFRVYSSANNCTFEYVSQPFLMDLE  (SEQ ID NO: 44)
dbj_BCA25654    121  NNATNVVIKVCEFQFCNDPFLGVYYHKNNKSWMESEFRVYSSANNCTFEYVSQPFLMDLE  (SEQ ID NO: 45)
gb_QHO62877     121  NNATNVVIKVCEFQFCNDPFLGVYYHKNNKSWMESEFRVYSSANNCTFEYVSQPFLMDLE  (SEQ ID NO: 46)
ref_YP_00972439 121  NNATNVVIKVCEFQFCNDPFLGVYYHKNNKSWMESEFRVYSSANNCTFEYVSQPFLMDLE  (SEQ ID NO: 47)
```

Fig. 2 (cont.)

| | | |
|---|---|---|
| gb_QHW06039 | 121 NNATNVVIKVCEFQFCNDPFLGVYYHKNNKSWMESEFRVYSSANNCTFEYVSQPFLMDLE | (SEQ ID No: 48) |
| gb_QHO62112 | 121 NNATNVVIKVCEFQFCNDPFLGVYYHKNNKSWMESEFRVYSSANNCTFEYVSQPFLMDLE | (SEQ ID No: 49) |
| gb_QHQ71973 | 121 NNATNVVIKVCEFQFCNDPFLGVYYHKNNKSWMESEFRVYSSANNCTFEYVSQPFLMDLE | (SEQ ID No: 50) |
| gb_QHW06049 | 121 NNATNVVIKVCEFQFCNDPFLGVYYHKNNKSWMESEFRVYSSANNCTFEYVSQPFLMDLE | (SEQ ID No: 51) |
| gb_QHO60594 | 121 NNATNVVIKVCEFQFCNDPFLGVYYHKNNKSWMESEFRVYSSANNCTFEYVSQPFLMDLE | (SEQ ID No: 52) |
| gb_QHN73810 | 121 NNATNVVIKVCEFQFCNDPFLGVYYHKNNKSWMESEFRVYSSANNCTFEYVSQPFLMDLE | (SEQ ID No: 53) |
| gb_QHO62107 | 121 NNATNVVIKVCEFQFCNDPFLGVYYHKNNKSWMESEFRVYSSANNCTFEYVSQPFLMDLE | (SEQ ID No: 54) |
| gb_QHQ82464 | 121 NNATNVVIKVCEFQFCNDPFLGVYYHKNNKSWMESEFRVYSSANNCTFEYVSQPFLMDLE | (SEQ ID No: 55) |
| dbj_BBW89517 | 121 NNATNVVIKVCEFQFCNDPFLGVYYHKNNKSWMESEFRVYSSANNCTFEYVSQPFLMDLE | (SEQ ID No: 56) |
| gb_QHU79204 | 121 NNATNVVIKVCEFQFCNDPFLGVYYHKNNKSWMESEFRVYSSANNCTFEYVSQPFLMDLE | (SEQ ID No: 57) |
| gb_QHQ71963 | 121 NNATNVVIKVCEFQFCNDPFLGVYYHKNNKSWMESEFRVYSSANNCTFEYVSQPFLMDLE | (SEQ ID No: 58) |
| gb_QHU79194 | 121 NNATNVVIKVCEFQFCNDPFLGVYYHKNNKSWMESEFRVYSSANNCTFEYVSQPFLMDLE | (SEQ ID No: 59) |
| gb_QHN73795 | 121 NNATNVVIKVCEFQFCNDPFLGVYYHKNNKSWMESEFRVYSSANNCTFEYVSQPFLMDLE | (SEQ ID No: 60) |
| gb_QHU36864 | 121 NNATNVVIKVCEFQFCNDPFLGVYYHKNNKSWMESEFRVYSSANNCTFEYVSQPFLMDLE | (SEQ ID No: 61) |
| gb_QHD43416 | 121 NNATNVVIKVCEFQFCNDPFLGVYYHKNNKSWMESEFRVYSSANNCTFEYVSQPFLMDLE | (SEQ ID No: 62) |
| gb_QHU36854 | 121 NNATNVVIKVCEFQFCNDPFLGVYYHKNNKSWMESEFRVYSSANNCTFEYVSQPFLMDLE | (SEQ ID No: 63) |
| gb_QHU36844 | 121 NNATNVVIKVCEFQFCNDPFLGVYYHKNNKSWMESEFRVYSSANNCTFEYVSQPFLMDLE | (SEQ ID No: 64) |
| gb_QHU36834 | 121 NNATNVVIKVCEFQFCNDPFLGVYYHKNNKSWMESEFRVYSSANNCTFEYVSQPFLMDLE | (SEQ ID No: 65) |
| gb_QHU36824 | 121 NNATNVVIKVCEFQFCNDPFLGVYYHKNNKSWMESEFRVYSSANNCTFEYVSQPFLMDLE | (SEQ ID No: 66) |
| consensus | 121 NNATNVVIKVCEFQFCNDPFLGVYYHKNNKSWMESEFRVYSSANNCTFEYVSQPFLMDLE | (SEQ ID No: 67) |

| | | |
|---|---|---|
| gb_QHW06059 | 181 GKQGNFKNLREFVFKNIDGYFKIYSKHTPINLVRDLPQGFSALEPLVDLPIGINITRFQT | (SEQ ID No: 25) |
| gb_QHZ00379 | 181 GKQGNFKNLREFVFKNIDGYFKIYSKHTPINLVRDLPQGFSALEPLVDLPIGINITRFQT | (SEQ ID No: 26) |
| gb_QHR84449 | 181 GKQGNFKNLREFVFKNIDGYFKIYSKHTPINLVRDLPQGFSALEPLVDLPIGINITRFQT | (SEQ ID No: 27) |
| gb_QIA20044 | 181 GKQGNFKNLREFVFKNIDGYFKIYSKHTPINLVRDLPQGFSALEPLVDLPIGINITRFQT | (SEQ ID No: 28) |
| gb_QHZ00358 | 181 GKQGNFKNLREFVFKNIDGYFKIYSKHTPINLVRDLPQGFSALEPLVDLPIGINITRFQT | (SEQ ID No: 29) |
| dbj_BCA25664 | 181 GKQGNFKNLREFVFKNIDGYFKIYSKHTPINLVRDLPQGFSALEPLVDLPIGINITRFQT | (SEQ ID No: 30) |
| gb_QHZ87582 | 181 GKQGNFKNLREFVFKNIDGYFKIYSKHTPINLVRDLPQGFSALEPLVDLPIGINITRFQT | (SEQ ID No: 31) |
| dbj_BCA25674 | 181 GKQGNFKNLREFVFKNIDGYFKIYSKHTPINLVRDLPQGFSALEPLVDLPIGINITRFQT | (SEQ ID No: 32) |
| gb_QHZ00389 | 181 GKQGNFKNLREFVFKNIDGYFKIYSKHTPINLVRDLPQGFSALEPLVDLPIGINITRFQT | (SEQ ID No: 33) |
| gb_QHZ87592 | 181 GKQGNFKNLREFVFKNIDGYFKIYSKHTPINLVRDLPQGFSALEPLVDLPIGINITRFQT | (SEQ ID No: 34) |
| gb_QIB84673 | 181 GKQGNFKNLREFVFKNIDGYFKIYSKHTPINLVRDLPQGFSALEPLVDLPIGINITRFQT | (SEQ ID No: 35) |
| gb_QHR63260 | 181 GKQGNFKNLREFVFKNIDGYFKIYSKHTPINLVRDLPQGFSALEPLVDLPIGINITRFQT | (SEQ ID No: 36) |
| gb_QIA98606 | 181 GKQGNFKNLREFVFKNIDGYFKIYSKHTPINLVRDLPQGFSALEPLVDLPIGINITRFQT | (SEQ ID No: 37) |
| gb_QIA98596 | 181 GKQGNFKNLREFVFKNIDGYFKIYSKHTPINLVRDLPQGFSALEPLVDLPIGINITRFQT | (SEQ ID No: 38) |
| gb_QHR63250 | 181 GKQGNFKNLREFVFKNIDGYFKIYSKHTPINLVRDLPQGFSALEPLVDLPIGINITRFQT | (SEQ ID No: 39) |
| gb_QHR63280 | 181 GKQGNFKNLREFVFKNIDGYFKIYSKHTPINLVRDLPQGFSALEPLVDLPIGINITRFQT | (SEQ ID No: 40) |
| gb_QHR63290 | 181 GKQGNFKNLREFVFKNIDGYFKIYSKHTPINLVRDLPQGFSALEPLVDLPIGINITRFQT | (SEQ ID No: 41) |

*Fig. 2 (cont.)*

| | | | |
|---|---|---|---|
| gb_QHR63270 | 181 | GKQGNFKNLREFVFKNIDGYFKIYSKHTPINLVRDLPQGFSALEPLVDLPIGINITRFQT | (SEQ ID No: 42) |
| gb_QHZ00399 | 181 | GKQGNFKNLREFVFKNIDGYFKIYSKHTPINLVRDLPQGFSALEPLVDLPIGINITRFQT | (SEQ ID No: 43) |
| dbj_BCA25644 | 181 | GKQGNFKNLREFVFKNIDGYFKIYSKHTPINLVRDLPQGFSALEPLVDLPIGINITRFQT | (SEQ ID No: 44) |
| dbj_BCA25654 | 181 | GKQGNFKNLREFVFKNIDGYFKIYSKHTPINLVRDLPQGFSALEPLVDLPIGINITRFQT | (SEQ ID No: 45) |
| gb_QHO62877 | 181 | GKQGNFKNLREFVFKNIDGYFKIYSKHTPINLVRDLPQGFSALEPLVDLPIGINITRFQT | (SEQ ID No: 46) |
| ref_YP_00972439 | 181 | GKQGNFKNLREFVFKNIDGYFKIYSKHTPINLVRDLPQGFSALEPLVDLPIGINITRFQT | (SEQ ID No: 47) |
| gb_QHW06039 | 181 | GKQGNFKNLREFVFKNIDGYFKIYSKHTPINLVRDLPQGFSALEPLVDLPIGINITRFQT | (SEQ ID No: 48) |
| gb_QHO62112 | 181 | GKQGNFKNLREFVFKNIDGYFKIYSKHTPINLVRDLPQGFSALEPLVDLPIGINITRFQT | (SEQ ID No: 49) |
| gb_QHQ71973 | 181 | GKQGNFKNLREFVFKNIDGYFKIYSKHTPINLVRDLPQGFSALEPLVDLPIGINITRFQT | (SEQ ID No: 50) |
| gb_QHW06049 | 181 | GKQGNFKNLREFVFKNIDGYFKIYSKHTPINLVRDLPQGFSALEPLVDLPIGINITRFQT | (SEQ ID No: 51) |
| gb_QHO60594 | 181 | GKQGNFKNLREFVFKNIDGYFKIYSKHTPINLVRDLPQGFSALEPLVDLPIGINITRFQT | (SEQ ID No: 52) |
| gb_QHN73810 | 181 | GKQGNFKNLREFVFKNIDGYFKIYSKHTPINLVRDLPQGFSALEPLVDLPIGINITRFQT | (SEQ ID No: 53) |
| gb_QHO62107 | 181 | GKQGNFKNLREFVFKNIDGYFKIYSKHTPINLVRDLPQGFSALEPLVDLPIGINITRFQT | (SEQ ID No: 54) |
| gb_QHQ82464 | 181 | GKQGNFKNLREFVFKNIDGYFKIYSKHTPINLVRDLPQGFSALEPLVDLPIGINITRFQT | (SEQ ID No: 55) |
| dbj_BBW89517 | 181 | GKQGNFKNLREFVFKNIDGYFKIYSKHTPINLVRDLPQGFSALEPLVDLPIGINITRFQT | (SEQ ID No: 56) |
| gb_QHU79204 | 181 | GKQGNFKNLREFVFKNIDGYFKIYSKHTPINLVRDLPQGFSALEPLVDLPIGINITRFQT | (SEQ ID No: 57) |
| gb_QHU71963 | 181 | GKQGNFKNLREFVFKNIDGYFKIYSKHTPINLVRDLPQGFSALEPLVDLPIGINITRFQT | (SEQ ID No: 58) |
| gb_QHU79194 | 181 | GKQGNFKNLREFVFKNIDGYFKIYSKHTPINLVRDLPQGFSALEPLVDLPIGINITRFQT | (SEQ ID No: 59) |
| gb_QHN73795 | 181 | GKQGNFKNLREFVFKNIDGYFKIYSKHTPINLVRDLPQGFSALEPLVDLPIGINITRFQT | (SEQ ID No: 60) |
| gb_QHU36864 | 181 | GKQGNFKNLREFVFKNIDGYFKIYSKHTPINLVRDLPQGFSALEPLVDLPIGINITRFQT | (SEQ ID No: 61) |
| gb_QHD43416 | 181 | GKQGNFKNLREFVFKNIDGYFKIYSKHTPINLVRDLPQGFSALEPLVDLPIGINITRFQT | (SEQ ID No: 62) |
| gb_QHU36854 | 181 | GKQGNFKNLREFVFKNIDGYFKIYSKHTPINLVRDLPQGFSALEPLVDLPIGINITRFQT | (SEQ ID No: 63) |
| gb_QHU36844 | 181 | GKQGNFKNLREFVFKNIDGYFKIYSKHTPINLVRDLPQGFSALEPLVDLPIGINITRFQT | (SEQ ID No: 64) |
| gb_QHU36834 | 181 | GKQGNFKNLREFVFKNIDGYFKIYSKHTPINLVRDLPQGFSALEPLVDLPIGINITRFQT | (SEQ ID No: 65) |
| gb_QHU36824 | 181 | GKQGNFKNLREFVFKNIDGYFKIYSKHTPINLVRDLPQGFSALEPLVDLPIGINITRFQT | (SEQ ID No: 66) |
| consensus | 181 | GKQGNFKNLREFVFKNIDGYFKIYSKHTPINLVRDLPQGFSALEPLVDLPIGINITRFQT | (SEQ ID No: 67) |
| gb_QHW06059 | 241 | LLALHRSYLTPGDSSSSGWTAGAAAYYVGYLQPRTFLLKYNENGTITDAVDCALDPLSETK | (SEQ ID No: 25) |
| gb_QHZ00379 | 241 | LLALHRSYLTPGDSSSSGWTAGAAAYYVGYLQPRTFLLKYNENGTITDAVDCALDPLSETK | (SEQ ID No: 26) |
| gb_QHR84449 | 241 | LLALHRRYLTPGDSSSSGWTAGAAAYYVGYLQPRTFLLKYNENGTITDAVDCALDPLSETK | (SEQ ID No: 27) |
| gb_QIA20044 | 241 | LLALHRSYLTPGDSSSSGWTAGAAAYYVGYLQPRTFLLKYNENGTITDAVDCALDPLSETK | (SEQ ID No: 28) |
| gb_QHZ00358 | 241 | LLALHRSYLTPGDSSSSGWTAGAAAYYVGYLQPRTFLLKYNENGTITDAVDCALDPLSETK | (SEQ ID No: 29) |
| dbj_BCA25664 | 241 | LLALHRSYLTPGDSSSSGWTAGAAAYYVGYLQPRTFLLKYNENGTITDAVDCALDPLSETK | (SEQ ID No: 30) |
| gb_QHZ87582 | 241 | LLALHRSYLTPGDSSSSGWTAGAAAYYVGYLQPRTFLLKYNENGTITDAVDCALDPLSETK | (SEQ ID No: 31) |
| dbj_BCA25674 | 241 | LLALHRSYLTPGDSSSSGWTAGAAAYYVGYLQPRTFLLKYNENGTITDAVDCALDPLSETK | (SEQ ID No: 32) |
| gb_QHZ00389 | 241 | LLALHRSYLTPGDSSSSGWTAGAAAYYVGYLQPRTFLLKYNENGTITDAVDCALDPLSETK | (SEQ ID No: 33) |
| gb_QHZ87592 | 241 | LLALHRSYLTPGDSSSSGWTAGAAAYYVGYLQPRTFLLKYNENGTITDAVDCALDPLSETK | (SEQ ID No: 34) |
| gb_QIB84673 | 241 | LLALHRSYLTPGDSSSSGWTAGAAAYYVGYLQPRTFLLKYNENGTITDAVDCALDPLSETK | (SEQ ID No: 35) |

*Fig. 2 (cont.)*

| | | | |
|---|---|---|---|
| gb_QHR63260 | 241 | LLALHRSYLTPGDSSSSGWTAGAAAYYVGYLQPRTFLLKYNENGTITDAVDCALDPLSETK | (SEQ ID No: 36) |
| gb_QIA98606 | 241 | LLALHRSYLTPGDSSSSGWTAGAAAYYVGYLQPRTFLLKYNENGTITDAVDCALDPLSETK | (SEQ ID No: 37) |
| gb_QIA98596 | 241 | LLALHRSYLTPGDSSSSGWTAGAAAYYVGYLQPRTFLLKYNENGTITDAVDCALDPLSETK | (SEQ ID No: 38) |
| gb_QHR63250 | 241 | LLALHRSYLTPGDSSSSGWTAGAAAYYVGYLQPRTFLLKYNENGTITDAVDCALDPLSETK | (SEQ ID No: 39) |
| gb_QHR63280 | 241 | LLALHRSYLTPGDSSSSGWTAGAAAYYVGYLQPRTFLLKYNENGTITDAVDCALDPLSETK | (SEQ ID No: 40) |
| gb_QHR63290 | 241 | LLALHRSYLTPGDSSSSGWTAGAAAYYVGYLQPRTFLLKYNENGTITDAVDCALDPLSETK | (SEQ ID No: 41) |
| gb_QHR63270 | 241 | LLALHRSYLTPGDSSSSGWTAGAAAYYVGYLQPRTFLLKYNENGTITDAVDCALDPLSETK | (SEQ ID No: 42) |
| gb_QHZ00399 | 241 | LLALHRSYLTPGDSSSSGWTAGAAAYYVGYLQPRTFLLKYNENGTITDAVDCALDPLSETK | (SEQ ID No: 43) |
| dbj_BCA25644 | 241 | LLALHRSYLTPGDSSSSGWTAGAAAYYVGYLQPRTFLLKYNENGTITDAVDCALDPLSETK | (SEQ ID No: 44) |
| dbj_BCA25654 | 241 | LLALHRSYLTPGDSSSSGWTAGAAAYYVGYLQPRTFLLKYNENGTITDAVDCALDPLSETK | (SEQ ID No: 45) |
| gb_QHQ62877 | 241 | LLALHRSYLTPGDSSSSGWTAGAAAYYVGYLQPRTFLLKYNENGTITDAVDCALDPLSETK | (SEQ ID No: 46) |
| ref_YP_009724390 | 241 | LLALHRSYLTPGDSSSSGWTAGAAAYYVGYLQPRTFLLKYNENGTITDAVDCALDPLSETK | (SEQ ID No: 47) |
| gb_QHW06039 | 241 | LLALHRSYLTPGDSSSSGWTAGAAAYYVGYLQPRTFLLKYNENGTITDAVDCALDPLSETK | (SEQ ID No: 48) |
| gb_QHQ62112 | 241 | LLALHRSYLTPGDSSSSGWTAGAAAYYVGYLQPRTFLLKYNENGTITDAVDCALDPLSETK | (SEQ ID No: 49) |
| gb_QHQ71973 | 241 | LLALHRSYLTPGDSSSSGWTAGAAAYYVGYLQPRTFLLKYNENGTITDAVDCALDPLSETK | (SEQ ID No: 50) |
| gb_QHW06049 | 241 | LLALHRSYLTPGDSSSSGWTAGAAAYYVGYLQPRTFLLKYNENGTITDAVDCALDPLSETK | (SEQ ID No: 51) |
| gb_QHO60594 | 241 | LLALHRSYLTPGDSSSSGWTAGAAAYYVGYLQPRTFLLKYNENGTITDAVDCALDPLSETK | (SEQ ID No: 52) |
| gb_QHN73810 | 241 | LLALHRSYLTPGDSSSSGWTAGAAAYYVGYLQPRTFLLKYNENGTITDAVDCALDPLSETK | (SEQ ID No: 53) |
| gb_QHQ62107 | 241 | LLALHRSYLTPGDSSSSGWTAGAAAYYVGYLQPRTFLLKYNENGTITDAVDCALDPLSETK | (SEQ ID No: 54) |
| gb_QHQ82464 | 241 | LLALHRSYLTPGDSSSSGWTAGAAAYYVGYLQPRTFLLKYNENGTITDAVDCALDPLSETK | (SEQ ID No: 55) |
| dbj_BBW89517 | 241 | LLALHRSYLTPGDSSSSGWTAGAAAYYVGYLQPRTFLLKYNENGTITDAVDCALDPLSETK | (SEQ ID No: 56) |
| gb_QHU79204 | 241 | LLALHRSYLTPGDSSSSGWTAGAAAYYVGYLQPRTFLLKYNENGTITDAVDCALDPLSETK | (SEQ ID No: 57) |
| gb_QHQ71963 | 241 | LLALHRSYLTPGDSSSSGWTAGAAAYYVGYLQPRTFLLKYNENGTITDAVDCALDPLSETK | (SEQ ID No: 58) |
| gb_QHU79194 | 241 | LLALHRSYLTPGDSSSSGWTAGAAAYYVGYLQPRTFLLKYNENGTITDAVDCALDPLSETK | (SEQ ID No: 59) |
| gb_QHN73795 | 241 | LLALHRSYLTPGDSSSSGWTAGAAAYYVGYLQPRTFLLKYNENGTITDAVDCALDPLSETK | (SEQ ID No: 60) |
| gb_QHU36864 | 241 | LLALHRSYLTPGDSSSSGWTAGAAAYYVGYLQPRTFLLKYNENGTITDAVDCALDPLSETK | (SEQ ID No: 61) |
| gb_QHD43416 | 241 | LLALHRSYLTPGDSSSSGWTAGAAAYYVGYLQPRTFLLKYNENGTITDAVDCALDPLSETK | (SEQ ID No: 62) |
| gb_QHU36854 | 241 | LLALHRSYLTPGDSSSSGWTAGAAAYYVGYLQPRTFLLKYNENGTITDAVDCALDPLSETK | (SEQ ID No: 63) |
| gb_QHU36844 | 241 | LLALHRSYLTPGDSSSSGWTAGAAAYYVGYLQPRTFLLKYNENGTITDAVDCALDPLSETK | (SEQ ID No: 64) |
| gb_QHU36834 | 241 | LLALHRSYLTPGDSSSSGWTAGAAAYYVGYLQPRTFLLKYNENGTITDAVDCALDPLSETK | (SEQ ID No: 65) |
| gb_QHU36824 | 241 | LLALHRSYLTPGDSSSSGWTAGAAAYYVGYLQPRTFLLKYNENGTITDAVDCALDPLSETK | (SEQ ID No: 66) |
| consensus | 241 | LLALHRSYLTPGDSSSSGWTAGAAAYYVGYLQPRTFLLKYNENGTITDAVDCALDPLSETK | (SEQ ID No: 67) |
| gb_QHW06059 | 301 | CTLKSFTVEKGIYQTSNFRVQPTESIVRFPNITNLCPFGEVFNATRFASVYAWNRKRISN | (SEQ ID No: 25) |
| gb_QHZ00379 | 301 | CTLKSFTVEKGIYQTSNFRVQPTESIVRFPNITNLCPFGEVFNATRFASVYAWNRKRISN | (SEQ ID No: 26) |
| gb_QHR84449 | 301 | CTLKSFTVEKGIYQTSNFRVQPTESIVRFPNITNLCPFGEVFNATRFASVYAWNRKRISN | (SEQ ID No: 27) |
| gb_QIA20044 | 301 | CTLKSFTVEKGIYQTSNFRVQPTESIVRFPNITNLCPFGEVFNATRFASVYAWNRKRISN | (SEQ ID No: 28) |

*Fig. 2 (cont.)*

| | | | |
|---|---|---|---|
| gb_QHZ00358 | 301 | CTLKSFTVEKGIYQTSNFRVQPTESIVRFPNITNLCPFGEVFNATRFASVYAWNRKRISN | (SEQ ID No: 29) |
| dbj_BCA25664 | 301 | CTLKSFTVEKGIYQTSNFRVQPTESIVRFPNITNLCPFGEVFNATRFASVYAWNRKRISN | (SEQ ID No: 30) |
| gb_QHZ87582 | 301 | CTLKSFTVEKGIYQTSNFRVQPTESIVRFPNITNLCPFGEVFNATRFASVYAWNRKRISN | (SEQ ID No: 31) |
| dbj_BCA25674 | 301 | CTLKSFTVEKGIYQTSNFRVQPTESIVRFPNITNLCPFGEVFNATRFASVYAWNRKRISN | (SEQ ID No: 32) |
| gb_QHZ00389 | 301 | CTLKSFTVEKGIYQTSNFRVQPTESIVRFPNITNLCPFGEVFNATRFASVYAWNRKRISN | (SEQ ID No: 33) |
| gb_QHZ87592 | 301 | CTLKSFTVEKGIYQTSNFRVQPTESIVRFPNITNLCPFGEVFNATRFASVYAWNRKRISN | (SEQ ID No: 34) |
| gb_QIB84673 | 301 | CTLKSFTVEKGIYQTSNFRVQPTESIVRFPNITNLCPFGEVFNATRFASVYAWNRKRISN | (SEQ ID No: 35) |
| gb_QHR63260 | 301 | CTLKSFTVEKGIYQTSNFRVQPTESIVRFPNITNLCPFGEVFNATRFASVYAWNRKRISN | (SEQ ID No: 36) |
| gb_QIA98606 | 301 | CTLKSFTVEKGIYQTSNFRVQPTESIVRFPNITNLCPFGEVFNATRFASVYAWNRKRISN | (SEQ ID No: 37) |
| gb_QIA98596 | 301 | CTLKSFTVEKGIYQTSNFRVQPTESIVRFPNITNLCPFGEVFNATRFASVYAWNRKRISN | (SEQ ID No: 38) |
| gb_QHR63250 | 301 | CTLKSFTVEKGIYQTSNFRVQPTESIVRFPNITNLCPFGEVFNATRFASVYAWNRKRISN | (SEQ ID No: 39) |
| gb_QHR63280 | 301 | CTLKSFTVEKGIYQTSNFRVQPTESIVRFPNITNLCPFGEVFNATRFASVYAWNRKRISN | (SEQ ID No: 40) |
| gb_QHR63290 | 301 | CTLKSFTVEKGIYQTSNFRVQPTESIVRFPNITNLCPFGEVFNATRFASVYAWNRKRISN | (SEQ ID No: 41) |
| gb_QHR63270 | 301 | CTLKSFTVEKGIYQTSNFRVQPTESIVRFPNITNLCPFGEVFNATRFASVYAWNRKRISN | (SEQ ID No: 42) |
| gb_QHZ00399 | 301 | CTLKSFTVEKGIYQTSNFRVQPTESIVRFPNITNLCPFGEVFNATRFASVYAWNRKRISN | (SEQ ID No: 43) |
| dbj_BCA25644 | 301 | CTLKSFTVEKGIYQTSNFRVQPTESIVRFPNITNLCPFGEVFNATRFASVYAWNRKRISN | (SEQ ID No: 44) |
| dbj_BCA25654 | 301 | CTLKSFTVEKGIYQTSNFRVQPTESIVRFPNITNLCPFGEVFNATRFASVYAWNRKRISN | (SEQ ID No: 45) |
| gb_QHO62877 | 301 | CTLKSFTVEKGIYQTSNFRVQPTESIVRFPNITNLCPFGEVFNATRFASVYAWNRKRISN | (SEQ ID No: 46) |
| ref_YP_00972439 | 301 | CTLKSFTVEKGIYQTSNFRVQPTESIVRFPNITNLCPFGEVFNATRFASVYAWNRKRISN | (SEQ ID No: 47) |
| gb_QHW06039 | 301 | CTLKSFTVEKGIYQTSNFRVQPTESIVRFPNITNLCPFGEVFNATRFASVYAWNRKRISN | (SEQ ID No: 48) |
| gb_QHO62112 | 301 | CTLKSFTVEKGIYQTSNFRVQPTESIVRFPNITNLCPFGEVFNATRFASVYAWNRKRISN | (SEQ ID No: 49) |
| gb_QHQ71973 | 301 | CTLKSFTVEKGIYQTSNFRVQPTESIVRFPNITNLCPFGEVFNATRFASVYAWNRKRISN | (SEQ ID No: 50) |
| gb_QHW06049 | 301 | CTLKSFTVEKGIYQTSNFRVQPTESIVRFPNITNLCPFGEVFNATRFASVYAWNRKRISN | (SEQ ID No: 51) |
| gb_QHO60594 | 301 | CTLKSFTVEKGIYQTSNFRVQPTESIVRFPNITNLCPFGEVFNATRFASVYAWNRKRISN | (SEQ ID No: 52) |
| gb_QHN73810 | 301 | CTLKSFTVEKGIYQTSNFRVQPTESIVRFPNITNLCPFGEVFNATRFASVYAWNRKRISN | (SEQ ID No: 53) |
| gb_QHO62107 | 301 | CTLKSFTVEKGIYQTSNFRVQPTESIVRFPNITNLCPFGEVFNATRFASVYAWNRKRISN | (SEQ ID No: 54) |
| gb_QHQ82464 | 301 | CTLKSFTVEKGIYQTSNFRVQPTESIVRFPNITNLCPFGEVFNATRFASVYAWNRKRISN | (SEQ ID No: 55) |
| dbj_BBW89517 | 301 | CTLKSFTVEKGIYQTSNFRVQPTESIVRFPNITNLCPFGEVFNATRFASVYAWNRKRISN | (SEQ ID No: 56) |
| gb_QHU79204 | 301 | CTLKSFTVEKGIYQTSNFRVQPTESIVRFPNITNLCPFGEVFNATRFASVYAWNRKRISN | (SEQ ID No: 57) |
| gb_QHQ71963 | 301 | CTLKSFTVEKGIYQTSNFRVQPTESIVRFPNITNLCPFGEVFNATRFASVYAWNRKRISN | (SEQ ID No: 58) |
| gb_QHU79194 | 301 | CTLKSFTVEKGIYQTSNFRVQPTESIVRFPNITNLCPFGEVFNATRFASVYAWNRKRISN | (SEQ ID No: 59) |
| gb_QHN73795 | 301 | CTLKSFTVEKGIYQTSNFRVQPTESIVRFPNITNLCPFGEVFNATRFASVYAWNRKRISN | (SEQ ID No: 60) |
| gb_QHU36864 | 301 | CTLKSFTVEKGIYQTSNFRVQPTESIVRFPNITNLCPFGEVFNATRFASVYAWNRKRISN | (SEQ ID No: 61) |
| gb_QHD43416 | 301 | CTLKSFTVEKGIYQTSNFRVQPTESIVRFPNITNLCPFGEVFNATRFASVYAWNRKRISN | (SEQ ID No: 62) |
| gb_QHU36854 | 301 | CTLKSFTVEKGIYQTSNFRVQPTESIVRFPNITNLCPFGEVFNATRFASVYAWNRKRISN | (SEQ ID No: 63) |

| | | | |
|---|---|---|---|
| gb_QHQ71963 | 361 | CVADYSVLYNSASFSTFKCYGVSPTKLNDLCFTNVYADSFVIRGDEVRQIAPGQTGKIAD | (SEQ ID NO: 58) |
| gb_QHU79194 | 361 | CVADYSVLYNSASFSTFKCYGVSPTKLNDLCFTNVYADSFVIRGDEVRQIAPGQTGKIAD | (SEQ ID NO: 59) |
| gb_QHN73795 | 361 | CVADYSVLYNSASFSTFKCYGVSPTKLNDLCFTNVYADSFVIRGDEVRQIAPGQTGKIAD | (SEQ ID NO: 60) |
| gb_QHU36864 | 361 | CVADYSVLYNSASFSTFKCYGVSPTKLNDLCFTNVYADSFVIRGDEVRQIAPGQTGKIAD | (SEQ ID NO: 61) |
| gb_QHD43416 | 361 | CVADYSVLYNSASFSTFKCYGVSPTKLNDLCFTNVYADSFVIRGDEVRQIAPGQTGKIAD | (SEQ ID NO: 62) |
| gb_QHU36854 | 361 | CVADYSVLYNSASFSTFKCYGVSPTKLNDLCFTNVYADSFVIRGDEVRQIAPGQTGKIAD | (SEQ ID NO: 63) |
| gb_QHU36844 | 361 | CVADYSVLYNSASFSTFKCYGVSPTKLNDLCFTNVYADSFVIRGDEVRQIAPGQTGKIAD | (SEQ ID NO: 64) |
| gb_QHU36834 | 361 | CVADYSVLYNSASFSTFKCYGVSPTKLNDLCFTNVYADSFVIRGDEVRQIAPGQTGKIAD | (SEQ ID NO: 65) |
| gb_QHU36824 | 361 | CVADYSVLYNSASFSTFKCYGVSPTKLNDLCFTNVYADSFVIRGDEVRQIAPGQTGKIAD | (SEQ ID NO: 66) |
| consensus | 361 | CVADYSVLYNSASFSTFKCYGVSPTKLNDLCFTNVYADSFVIRGDEVRQIAPGQTGKIAD | (SEQ ID NO: 67) |
| gb_QHW06059 | 421 | YNYKLPDDFTGCVIAWNSNNLDSKVGGNYNYLYRLFRKSNLKPFERDISTEIYQAGSTPC | (SEQ ID NO: 25) |
| gb_QHZ00379 | 421 | YNYKLPDDFTGCVIAWNSNNLDSKVGGNYNYLYRLFRKSNLKPFERDISTEIYQAGSTPC | (SEQ ID NO: 26) |
| gb_QHR84449 | 421 | YNYKLPDDFTGCVIAWNSNNLDSKVGGNYNYLYRLFRKSNLKPFERDISTEIYQAGSTPC | (SEQ ID NO: 27) |
| gb_QIA20044 | 421 | YNYKLPDDFTGCVIAWNSNNLDSKVGGNYNYLYRLFRKSNLKPFERDISTEIYQAGSTPC | (SEQ ID NO: 28) |
| gb_QHZ00358 | 421 | YNYKLPDDFTGCVIAWNSNNLDSKVGGNYNYLYRLFRKSNLKPFERDISTEIYQAGSTPC | (SEQ ID NO: 29) |
| dbj_BCA25664 | 421 | YNYKLPDDFTGCVIAWNSNNLDSKVGGNYNYLYRLFRKSNLKPFERDISTEIYQAGSTPC | (SEQ ID NO: 30) |
| gb_QHZ87582 | 421 | YNYKLPDDFTGCVIAWNSNNLDSKVGGNYNYLYRLFRKSNLKPFERDISTEIYQAGSTPC | (SEQ ID NO: 31) |
| dbj_BCA25674 | 421 | YNYKLPDDFTGCVIAWNSNNLDSKVGGNYNYLYRLFRKSNLKPFERDISTEIYQAGSTPC | (SEQ ID NO: 32) |
| gb_QHZ00389 | 421 | YNYKLPDDFTGCVIAWNSNNLDSKVGGNYNYLYRLFRKSNLKPFERDISTEIYQAGSTPC | (SEQ ID NO: 33) |
| gb_QHZ87592 | 421 | YNYKLPDDFTGCVIAWNSNNLDSKVGGNYNYLYRLFRKSNLKPFERDISTEIYQAGSTPC | (SEQ ID NO: 34) |
| gb_QIB84673 | 421 | YNYKLPDDFTGCVIAWNSNNLDSKVGGNYNYLYRLFRKSNLKPFERDISTEIYQAGSTPC | (SEQ ID NO: 35) |
| gb_QHR63260 | 421 | YNYKLPDDFTGCVIAWNSNNLDSKVGGNYNYLYRLFRKSNLKPFERDISTEIYQAGSTPC | (SEQ ID NO: 36) |
| gb_QIA99606 | 421 | YNYKLPDDFTGCVIAWNSNNLDSKVGGNYNYLYRLFRKSNLKPFERDISTEIYQAGSTPC | (SEQ ID NO: 37) |
| gb_QIA98596 | 421 | YNYKLPDDFTGCVIAWNSNNLDSKVGGNYNYLYRLFRKSNLKPFERDISTEIYQAGSTPC | (SEQ ID NO: 38) |
| gb_QHR63250 | 421 | YNYKLPDDFTGCVIAWNSNNLDSKVGGNYNYLYRLFRKSNLKPFERDISTEIYQAGSTPC | (SEQ ID NO: 39) |
| gb_QHR63280 | 421 | YNYKLPDDFTGCVIAWNSNNLDSKVGGNYNYLYRLFRKSNLKPFERDISTEIYQAGSTPC | (SEQ ID NO: 40) |
| gb_QHR63290 | 421 | YNYKLPDDFTGCVIAWNSNNLDSKVGGNYNYLYRLFRKSNLKPFERDISTEIYQAGSTPC | (SEQ ID NO: 41) |
| gb_QHZ00399 | 421 | YNYKLPDDFTGCVIAWNSNNLDSKVGGNYNYLYRLFRKSNLKPFERDISTEIYQAGSTPC | (SEQ ID NO: 42) |
| dbj_BCA25644 | 421 | YNYKLPDDFTGCVIAWNSNNLDSKVGGNYNYLYRLFRKSNLKPFERDISTEIYQAGSTPC | (SEQ ID NO: 43) |
| dbj_BCA25654 | 421 | YNYKLPDDFTGCVIAWNSNNLDSKVGGNYNYLYRLFRKSNLKPFERDISTEIYQAGSTPC | (SEQ ID NO: 44) |
| gb_QHO62877 | 421 | YNYKLPDDFTGCVIAWNSNNLDSKVGGNYNYLYRLFRKSNLKPFERDISTEIYQAGSTPC | (SEQ ID NO: 45) |
| ref_YP_009972439 | 421 | YNYKLPDDFTGCVIAWNSNNLDSKVGGNYNYLYRLFRKSNLKPFERDISTEIYQAGSTPC | (SEQ ID NO: 46) |
| gb_QHW06039 | 421 | YNYKLPDDFTGCVIAWNSNNLDSKVGGNYNYLYRLFRKSNLKPFERDISTEIYQAGSTPC | (SEQ ID NO: 47) |
| gb_QHO62112 | 421 | YNYKLPDDFTGCVIAWNSNNLDSKVGGNYNYLYRLFRKSNLKPFERDISTEIYQAGSTPC | (SEQ ID NO: 48) |
| gb_QHQ71973 | 421 | YNYKLPDDFTGCVIAWNSNNLDSKVGGNYNYLYRLFRKSNLKPFERDISTEIYQAGSTPC | (SEQ ID NO: 49) |
| gb_QHW06049 | 421 | YNYKLPDDFTGCVIAWNSNNLDSKVGGNYNYLYRLFRKSNLKPFERDISTEIYQAGSTPC | (SEQ ID NO: 50) |
| | 421 | YNYKLPDDFTGCVIAWNSNNLDSKVGGNYNYLYRLFRKSNLKPFERDISTEIYQAGSTPC | (SEQ ID NO: 51) |

Fig. 2 (cont.)

| | | | |
|---|---|---|---|
| gb_QHO60594 | 421 | YNYKLPDDFTGCVIAWNSNNLDSKVGGNYNYLYRLFRKSNLKPFERDISTEIYQAGSTPC | (SEQ ID No: 52) |
| gb_QHN73810 | 421 | YNYKLPDDFTGCVIAWNSNNLDSKVGGNYNYLYRLFRKSNLKPFERDISTEIYQAGSTPC | (SEQ ID No: 53) |
| gb_QHO62107 | 421 | YNYKLPDDFTGCVIAWNSNNLDSKVGGNYNYLYRLFRKSNLKPFERDISTEIYQAGSTPC | (SEQ ID No: 54) |
| gb_QHQ82464 | 421 | YNYKLPDDFTGCVIAWNSNNLDSKVGGNYNYLYRLFRKSNLKPFERDISTEIYQAGSTPC | (SEQ ID No: 55) |
| dbj_BBW89517 | 421 | YNYKLPDDFTGCVIAWNSNNLDSKVGGNYNYLYRLFRKSNLKPFERDISTEIYQAGSTPC | (SEQ ID No: 56) |
| gb_QHU79204 | 421 | YNYKLPDDFTGCVIAWNSNNLDSKVGGNYNYLYRLFRKSNLKPFERDISTEIYQAGSTPC | (SEQ ID No: 57) |
| gb_QHQ71963 | 421 | YNYKLPDDFTGCVIAWNSNNLDSKVGGNYNYLYRLFRKSNLKPFERDISTEIYQAGSTPC | (SEQ ID No: 58) |
| gb_QHU79194 | 421 | YNYKLPDDFTGCVIAWNSNNLDSKVGGNYNYLYRLFRKSNLKPFERDISTEIYQAGSTPC | (SEQ ID No: 59) |
| gb_QHN73795 | 421 | YNYKLPDDFTGCVIAWNSNNLDSKVGGNYNYLYRLFRKSNLKPFERDISTEIYQAGSTPC | (SEQ ID No: 60) |
| gb_QHU36864 | 421 | YNYKLPDDFTGCVIAWNSNNLDSKVGGNYNYLYRLFRKSNLKPFERDISTEIYQAGSTPC | (SEQ ID No: 61) |
| gb_QHD43416 | 421 | YNYKLPDDFTGCVIAWNSNNLDSKVGGNYNYLYRLFRKSNLKPFERDISTEIYQAGSTPC | (SEQ ID No: 62) |
| gb_QHU36854 | 421 | YNYKLPDDFTGCVIAWNSNNLDSKVGGNYNYLYRLFRKSNLKPFERDISTEIYQAGSTPC | (SEQ ID No: 63) |
| gb_QHU36844 | 421 | YNYKLPDDFTGCVIAWNSNNLDSKVGGNYNYLYRLFRKSNLKPFERDISTEIYQAGSTPC | (SEQ ID No: 64) |
| gb_QHU36834 | 421 | YNYKLPDDFTGCVIAWNSNNLDSKVGGNYNYLYRLFRKSNLKPFERDISTEIYQAGSTPC | (SEQ ID No: 65) |
| gb_QHU36824 | 421 | YNYKLPDDFTGCVIAWNSNNLDSKVGGNYNYLYRLFRKSNLKPFERDISTEIYQAGSTPC | (SEQ ID No: 66) |
| consensus | 421 | YNYKLPDDFTGCVIAWNSNNLDSKVGGNYNYLYRLFRKSNLKPFERDISTEIYQAGSTPC | (SEQ ID No: 67) |
| gb_QHW06059 | 481 | NGVEGFNCYFPLQSYGFQPTNGVGYQPYRVVVLSFELLHAPATVCGPKKSTNLVKNKCVN | (SEQ ID No: 25) |
| gb_QHZ00379 | 481 | NGVEGFNCYFPLQSYGFQPTNGVGYQPYRVVVLSFELLHAPATVCGPKKSTNLVKNKCVN | (SEQ ID No: 26) |
| gb_QHR84449 | 481 | NGVEGFNCYFPLQSYGFQPTNGVGYQPYRVVVLSFELLHAPATVCGPKKSTNLVKNKCVN | (SEQ ID No: 27) |
| gb_QIA20044 | 481 | NGVEGFNCYFPLQSYGFQPTNGVGYQPYRVVVLSFELLHAPATVCGPKKSTNLVKNKCVN | (SEQ ID No: 28) |
| gb_QHZ00358 | 481 | NGVEGFNCYFPLQSYGFQPTNGVGYQPYRVVVLSFELLHAPATVCGPKKSTNLVKNKCVN | (SEQ ID No: 29) |
| dbj_BCA25664 | 481 | NGVEGFNCYFPLQSYGFQPTNGVGYQPYRVVVLSFELLHAPATVCGPKKSTNLVKNKCVN | (SEQ ID No: 30) |
| gb_QHZ87582 | 481 | NGVEGFNCYFPLQSYGFQPTNGVGYQPYRVVVLSFELLHAPATVCGPKKSTNLVKNKCVN | (SEQ ID No: 31) |
| dbj_BCA25674 | 481 | NGVEGFNCYFPLQSYGFQPTNGVGYQPYRVVVLSFELLHAPATVCGPKKSTNLVKNKCVN | (SEQ ID No: 32) |
| gb_QHZ00389 | 481 | NGVEGFNCYFPLQSYGFQPTNGVGYQPYRVVVLSFELLHAPATVCGPKKSTNLVKNKCVN | (SEQ ID No: 33) |
| gb_QHZ87592 | 481 | NGVEGFNCYFPLQSYGFQPTNGVGYQPYRVVVLSFELLHAPATVCGPKKSTNLVKNKCVN | (SEQ ID No: 34) |
| gb_QIB84673 | 481 | NGVEGFNCYFPLQSYGFQPTNGVGYQPYRVVVLSFELLHAPATVCGPKKSTNLVKNKCVN | (SEQ ID No: 35) |
| gb_QHR63260 | 481 | NGVEGFNCYFPLQSYGFQPTNGVGYQPYRVVVLSFELLHAPATVCGPKKSTNLVKNKCVN | (SEQ ID No: 36) |
| gb_QIA98606 | 481 | NGVEGFNCYFPLQSYGFQPTNGVGYQPYRVVVLSFELLHAPATVCGPKKSTNLVKNKCVN | (SEQ ID No: 37) |
| gb_QIA98596 | 481 | NGVEGFNCYFPLQSYGFQPTNGVGYQPYRVVVLSFELLHAPATVCGPKKSTNLVKNKCVN | (SEQ ID No: 38) |
| gb_QHR63250 | 481 | NGVEGFNCYFPLQSYGFQPTNGVGYQPYRVVVLSFELLHAPATVCGPKKSTNLVKNKCVN | (SEQ ID No: 39) |
| gb_QHR63280 | 481 | NGVEGFNCYFPLQSYGFQPTNGVGYQPYRVVVLSFELLHAPATVCGPKKSTNLVKNKCVN | (SEQ ID No: 40) |
| gb_QHR63290 | 481 | NGVEGFNCYFPLQSYGFQPTNGVGYQPYRVVVLSFELLHAPATVCGPKKSTNLVKNKCVN | (SEQ ID No: 41) |
| gb_QHR63270 | 481 | NGVEGFNCYFPLQSYGFQPTNGVGYQPYRVVVLSFELLHAPATVCGPKKSTNLVKNKCVN | (SEQ ID No: 42) |
| gb_QHZ00399 | 481 | NGVEGFNCYFPLQSYGFQPTNGVGYQPYRVVVLSFELLHAPATVCGPKKSTNLVKNKCVN | (SEQ ID No: 43) |
| dbj_BCA25644 | 481 | NGVEGFNCYFPLQSYGFQPTNGVGYQPYRVVVLSFELLHAPATVCGPKKSTNLVKNKCVN | (SEQ ID No: 44) |

*Fig. 2 (cont.)*

| Accession | Pos | Sequence | SEQ ID |
|---|---|---|---|
| dbj_BCA25654 | 481 | NGVEGFNCYFPLQSYGFQPTNGVGYQPYRVVVLSFELLHAPATVCGPKKSTNLVKNKCVN | (SEQ ID No: 45) |
| gb_QHO62877 | 481 | NGVEGFNCYFPLQSYGFQPTNGVGYQPYRVVVLSFELLHAPATVCGPKKSTNLVKNKCVN | (SEQ ID No: 46) |
| ref_YP_00972439 | 481 | NGVEGFNCYFPLQSYGFQPTNGVGYQPYRVVVLSFELLHAPATVCGPKKSTNLVKNKCVN | (SEQ ID No: 47) |
| gb_QHW06039 | 481 | NGVEGFNCYFPLQSYGFQPTNGVGYQPYRVVVLSFELLHAPATVCGPKKSTNLVKNKCVN | (SEQ ID No: 48) |
| gb_QHO62112 | 481 | NGVEGFNCYFPLQSYGFQPTNGVGYQPYRVVVLSFELLHAPATVCGPKKSTNLVKNKCVN | (SEQ ID No: 49) |
| gb_QHQ71973 | 481 | NGVEGFNCYFPLQSYGFQPTNGVGYQPYRVVVLSFELLHAPATVCGPKKSTNLVKNKCVN | (SEQ ID No: 50) |
| gb_QHW06049 | 481 | NGVEGFNCYFPLQSYGFQPTNGVGYQPYRVVVLSFELLHAPATVCGPKKSTNLVKNKCVN | (SEQ ID No: 51) |
| gb_QHO60594 | 481 | NGVEGFNCYFPLQSYGFQPTNGVGYQPYRVVVLSFELLHAPATVCGPKKSTNLVKNKCVN | (SEQ ID No: 52) |
| gb_QHN73810 | 481 | NGVEGFNCYFPLQSYGFQPTNGVGYQPYRVVVLSFELLHAPATVCGPKKSTNLVKNKCVN | (SEQ ID No: 53) |
| gb_QHO62107 | 481 | NGVEGFNCYFPLQSYGFQPTNGVGYQPYRVVVLSFELLHAPATVCGPKKSTNLVKNKCVN | (SEQ ID No: 54) |
| gb_QHQ82464 | 481 | NGVEGFNCYFPLQSYGFQPTNGVGYQPYRVVVLSFELLHAPATVCGPKKSTNLVKNKCVN | (SEQ ID No: 55) |
| dbj_BBW89517 | 481 | NGVEGFNCYFPLQSYGFQPTNGVGYQPYRVVVLSFELLHAPATVCGPKKSTNLVKNKCVN | (SEQ ID No: 56) |
| gb_QHU79204 | 481 | NGVEGFNCYFPLQSYGFQPTNGVGYQPYRVVVLSFELLHAPATVCGPKKSTNLVKNKCVN | (SEQ ID No: 57) |
| gb_QHQ71963 | 481 | NGVEGFNCYFPLQSYGFQPTNGVGYQPYRVVVLSFELLHAPATVCGPKKSTNLVKNKCVN | (SEQ ID No: 58) |
| gb_QHU79194 | 481 | NGVEGFNCYFPLQSYGFQPTNGVGYQPYRVVVLSFELLHAPATVCGPKKSTNLVKNKCVN | (SEQ ID No: 59) |
| gb_QHN73795 | 481 | NGVEGFNCYFPLQSYGFQPTNGVGYQPYRVVVLSFELLHAPATVCGPKKSTNLVKNKCVN | (SEQ ID No: 60) |
| gb_QHU36864 | 481 | NGVEGFNCYFPLQSYGFQPTNGVGYQPYRVVVLSFELLHAPATVCGPKKSTNLVKNKCVN | (SEQ ID No: 61) |
| gb_QHD43416 | 481 | NGVEGFNCYFPLQSYGFQPTNGVGYQPYRVVVLSFELLHAPATVCGPKKSTNLVKNKCVN | (SEQ ID No: 62) |
| gb_QHU36854 | 481 | NGVEGFNCYFPLQSYGFQPTNGVGYQPYRVVVLSFELLHAPATVCGPKKSTNLVKNKCVN | (SEQ ID No: 63) |
| gb_QHU36844 | 481 | NGVEGFNCYFPLQSYGFQPTNGVGYQPYRVVVLSFELLHAPATVCGPKKSTNLVKNKCVN | (SEQ ID No: 64) |
| gb_QHU36834 | 481 | NGVEGFNCYFPLQSYGFQPTNGVGYQPYRVVVLSFELLHAPATVCGPKKSTNLVKNKCVN | (SEQ ID No: 65) |
| gb_QHU36824 | 481 | NGVEGFNCYFPLQSYGFQPTNGVGYQPYRVVVLSFELLHAPATVCGPKKSTNLVKNKCVN | (SEQ ID No: 66) |
| consensus | | NGVEGFNCYFPLQSYGFQPTNGVGYQPYRVVVLSFELLHAPATVCGPKKSTNLVKNKCVN | (SEQ ID No: 67) |
| gb_QHW06059 | 541 | FNFNGLTGTGVILTESNKKFLPFQQFGRDIADTTDAVRDPQTLEILDITPCSFGGVSVITP | (SEQ ID No: 25) |
| gb_QHZ00379 | 541 | FNFNGLTGTGVILTESNKKFLPFQQFGRDIADTTDAVRDPQTLEILDITPCSFGGVSVITP | (SEQ ID No: 26) |
| gb_QHR84449 | 541 | FNFNGLTGTGVILTESNKKFLPFQQFGRDIADTTDAVRDPQTLEILDITPCSFGGVSVITP | (SEQ ID No: 27) |
| gb_QIA20044 | 541 | FNFNGLTGTGVILTESNKKFLPFQQFGRDIADTTDAVRDPQTLEILDITPCSFGGVSVITP | (SEQ ID No: 28) |
| gb_QHZ00358 | 541 | FNFNGLTGTGVILTESNKKFLPFQQFGRDIADTTDAVRDPQTLEILDITPCSFGGVSVITP | (SEQ ID No: 29) |
| dbj_BCA25664 | 541 | FNFNGLTGTGVILTESNKKFLPFQQFGRDIADTTDAVRDPQTLEILDITPCSFGGVSVITP | (SEQ ID No: 30) |
| gb_QHZ87582 | 541 | FNFNGLTGTGVILTESNKKFLPFQQFGRDIADTTDAVRDPQTLEILDITPCSFGGVSVITP | (SEQ ID No: 31) |
| dbj_BCA25674 | 541 | FNFNGLTGTGVILTESNKKFLPFQQFGRDIADTTDAVRDPQTLEILDITPCSFGGVSVITP | (SEQ ID No: 32) |
| gb_QHZ00389 | 541 | FNFNGLTGTGVILTESNKKFLPFQQFGRDIADTTDAVRDPQTLEILDITPCSFGGVSVITP | (SEQ ID No: 33) |
| gb_QHZ87592 | 541 | FNFNGLTGTGVILTESNKKFLPFQQFGRDIADTTDAVRDPQTLEILDITPCSFGGVSVITP | (SEQ ID No: 34) |
| gb_QIB84673 | 541 | FNFNGLTGTGVILTESNKKFLPFQQFGRDIADTTDAVRDPQTLEILDITPCSFGGVSVITP | (SEQ ID No: 35) |
| gb_QHR63260 | 541 | FNFNGLTGTGVILTESNKKFLPFQQFGRDIADTTDAVRDPQTLEILDITPCSFGGVSVITP | (SEQ ID No: 36) |
| gb_QIA98606 | 541 | FNFNGLTGTGVILTESNKKFLPFQQFGRDIADTTDAVRDPQTLEILDITPCSFGGVSVITP | (SEQ ID No: 37) |

*Fig. 2 (cont.)*

| | | | |
|---|---|---|---|
| gb_QIA98596 | 541 | FNFNGLTGTGVLTESNKKFLPFQQFGRDIADTTDAVRDPQTLEILDITPCSFGGVSVITP | (SEQ ID No: 38) |
| gb_QHR63250 | 541 | FNFNGLTGTGVLTESNKKFLPFQQFGRDIADTTDAVRDPQTLEILDITPCSFGGVSVITP | (SEQ ID No: 39) |
| gb_QHR63280 | 541 | FNFNGLTGTGVLTESNKKFLPFQQFGRDIADTTDAVRDPQTLEILDITPCSFGGVSVITP | (SEQ ID No: 40) |
| gb_QHR63290 | 541 | FNFNGLTGTGVLTESNKKFLPFQQFGRDIADTTDAVRDPQTLEILDITPCSFGGVSVITP | (SEQ ID No: 41) |
| gb_QHR63270 | 541 | FNFNGLTGTGVLTESNKKFLPFQQFGRDIADTTDAVRDPQTLEILDITPCSFGGVSVITP | (SEQ ID No: 42) |
| gb_QHZ00399 | 541 | FNFNGLTGTGVLTESNKKFLPFQQFGRDIADTTDAVRDPQTLEILDITPCSFGGVSVITP | (SEQ ID No: 43) |
| dbj_BCA25644 | 541 | FNFNGLTGTGVLTESNKKFLPFQQFGRDIADTTDAVRDPQTLEILDITPCSFGGVSVITP | (SEQ ID No: 44) |
| dbj_BCA25654 | 541 | FNFNGLTGTGVLTESNKKFLPFQQFGRDIADTTDAVRDPQTLEILDITPCSFGGVSVITP | (SEQ ID No: 45) |
| gb_QHO62877 | 541 | FNFNGLTGTGVLTESNKKFLPFQQFGRDIADTTDAVRDPQTLEILDITPCSFGGVSVITP | (SEQ ID No: 46) |
| ref_YP_00972439 | 541 | FNFNGLTGTGVLTESNKKFLPFQQFGRDIADTTDAVRDPQTLEILDITPCSFGGVSVITP | (SEQ ID No: 47) |
| gb_QHW06039 | 541 | FNFNGLTGTGVLTESNKKFLPFQQFGRDIADTTDAVRDPQTLEILDITPCSFGGVSVITP | (SEQ ID No: 48) |
| gb_QHO62112 | 541 | FNFNGLTGTGVLTESNKKFLPFQQFGRDIADTTDAVRDPQTLEILDITPCSFGGVSVITP | (SEQ ID No: 49) |
| gb_QHQ71973 | 541 | FNFNGLTGTGVLTESNKKFLPFQQFGRDIADTTDAVRDPQTLEILDITPCSFGGVSVITP | (SEQ ID No: 50) |
| gb_QHW06049 | 541 | FNFNGLTGTGVLTESNKKFLPFQQFGRDIADTTDAVRDPQTLEILDITPCSFGGVSVITP | (SEQ ID No: 51) |
| gb_QHO60594 | 541 | FNFNGLTGTGVLTESNKKFLPFQQFGRDIADTTDAVRDPQTLEILDITPCSFGGVSVITP | (SEQ ID No: 52) |
| gb_QHN73810 | 541 | FNFNGLTGTGVLTESNKKFLPFQQFGRDIADTTDAVRDPQTLEILDITPCSFGGVSVITP | (SEQ ID No: 53) |
| gb_QHO62107 | 541 | FNFNGLTGTGVLTESNKKFLPFQQFGRDIADTTDAVRDPQTLEILDITPCSFGGVSVITP | (SEQ ID No: 54) |
| gb_QHQ82464 | 541 | FNFNGLTGTGVLTESNKKFLPFQQFGRDIADTTDAVRDPQTLEILDITPCSFGGVSVITP | (SEQ ID No: 55) |
| dbj_BBW89517 | 541 | FNFNGLTGTGVLTESNKKFLPFQQFGRDIADTTDAVRDPQTLEILDITPCSFGGVSVITP | (SEQ ID No: 56) |
| gb_QHU79204 | 541 | FNFNGLTGTGVLTESNKKFLPFQQFGRDIADTTDAVRDPQTLEILDITPCSFGGVSVITP | (SEQ ID No: 57) |
| gb_QHQ71963 | 541 | FNFNGLTGTGVLTESNKKFLPFQQFGRDIADTTDAVRDPQTLEILDITPCSFGGVSVITP | (SEQ ID No: 58) |
| gb_QHU79194 | 541 | FNFNGLTGTGVLTESNKKFLPFQQFGRDIADTTDAVRDPQTLEILDITPCSFGGVSVITP | (SEQ ID No: 59) |
| gb_QHN73795 | 541 | FNFNGLTGTGVLTESNKKFLPFQQFGRDIADTTDAVRDPQTLEILDITPCSFGGVSVITP | (SEQ ID No: 60) |
| gb_QHU36864 | 541 | FNFNGLTGTGVLTESNKKFLPFQQFGRDIADTTDAVRDPQTLEILDITPCSFGGVSVITP | (SEQ ID No: 61) |
| gb_QHD43416 | 541 | FNFNGLTGTGVLTESNKKFLPFQQFGRDIADTTDAVRDPQTLEILDITPCSFGGVSVITP | (SEQ ID No: 62) |
| gb_QHU36854 | 541 | FNFNGLTGTGVLTESNKKFLPFQQFGRDIADTTDAVRDPQTLEILDITPCSFGGVSVITP | (SEQ ID No: 63) |
| gb_QHU36844 | 541 | FNFNGLTGTGVLTESNKKFLPFQQFGRDIADTTDAVRDPQTLEILDITPCSFGGVSVITP | (SEQ ID No: 64) |
| gb_QHU36834 | 541 | FNFNGLTGTGVLTESNKKFLPFQQFGRDIADTTDAVRDPQTLEILDITPCSFGGVSVITP | (SEQ ID No: 65) |
| gb_QHU36824 | 541 | FNFNGLTGTGVLTESNKKFLPFQQFGRDIADTTDAVRDPQTLEILDITPCSFGGVSVITP | (SEQ ID No: 66) |
| consensus | 541 | FNFNGLTGTGVLTESNKKFLPFQQFGRDIADTTDAVRDPQTLEILDITPCSFGGVSVITP | (SEQ ID No: 67) |
| | | | |
| gb_QHW06059 | 601 | GTNTSNQVAVLYQDVNCTEVPVAIHADQLTPTWRVYSTGSNVFQTRAGCLIGAEHVNNSY | (SEQ ID No: 25) |
| gb_QHZ00379 | 601 | GTNTSNQVAVLYQDVNCTEVPVAIHADQLTPTWRVYSTGSNVFQTRAGCLIGAEHVNNSY | (SEQ ID No: 26) |
| gb_QHR84449 | 601 | GTNTSNQVAVLYQDVNCTEVPVAIHADQLTPTWRVYSTGSNVFQTRAGCLIGAEHVNNSY | (SEQ ID No: 27) |
| gb_QIA20044 | 601 | GTNTSNQVAVLYQDVNCTEVPVAIHADQLTPTWRVYSTGSNVFQTRAGCLIGAEHVNNSY | (SEQ ID No: 28) |
| gb_QHZ00358 | 601 | GTNTSNQVAVLYQDVNCTEVPVAIHADQLTPTWRVYSTGSNVFQTRAGCLIGAEHVNNSY | (SEQ ID No: 29) |
| dbj_BCA25664 | 601 | GTNTSNQVAVLYQDVNCTEVPVAIHADQLTPTWRVYSTGSNVFQTRAGCLIGAEHVNNSY | (SEQ ID No: 30) |
| gb_QHZ87582 | 601 | GTNTSNQVAVLYQDVNCTEVPVAIHADQLTPTWRVYSTGSNVFQTRAGCLIGAEHVNNSY | (SEQ ID No: 31) |

*Fig. 2 (cont.)*

| Accession | Pos | Sequence | SEQ ID |
|---|---|---|---|
| dbj_BCA25674 | 601 | GTNTSNQVAVLYQDVNCTEVPVAIHADQLTPTWRVYSTGSNVFQTRAGCLIGAEHVNNSY | (SEQ ID No: 32) |
| gb_QHZ00389 | 601 | GTNTSNQVAVLYQDVNCTEVPVAIHADQLTPTWRVYSTGSNVFQTRAGCLIGAEHVNNSY | (SEQ ID No: 33) |
| gb_QHZ87592 | 601 | GTNTSNQVAVLYQDVNCTEVPVAIHADQLTPTWRVYSTGSNVFQTRAGCLIGAEHVNNSY | (SEQ ID No: 34) |
| gb_QIB84673 | 601 | GTNTSNQVAVLYQDVNCTEVPVAIHADQLTPTWRVYSTGSNVFQTRAGCLIGAEHVNNSY | (SEQ ID No: 35) |
| gb_QHR63260 | 601 | GTNTSNQVAVLYQDVNCTEVPVAIHADQLTPTWRVYSTGSNVFQTRAGCLIGAEHVNNSY | (SEQ ID No: 36) |
| gb_QIA98606 | 601 | GTNTSNQVAVLYQDVNCTEVPVAIHADQLTPTWRVYSTGSNVFQTRAGCLIGAEHVNNSY | (SEQ ID No: 37) |
| gb_QIA98596 | 601 | GTNTSNQVAVLYQDVNCTEVPVAIHADQLTPTWRVYSTGSNVFQTRAGCLIGAEHVNNSY | (SEQ ID No: 38) |
| gb_QHR63250 | 601 | GTNTSNQVAVLYQDVNCTEVPVAIHADQLTPTWRVYSTGSNVFQTRAGCLIGAEHVNNSY | (SEQ ID No: 39) |
| gb_QHR63280 | 601 | GTNTSNQVAVLYQDVNCTEVPVAIHADQLTPTWRVYSTGSNVFQTRAGCLIGAEHVNNSY | (SEQ ID No: 40) |
| gb_QHR63290 | 601 | GTNTSNQVAVLYQDVNCTEVPVAIHADQLTPTWRVYSTGSNVFQTRAGCLIGAEHVNNSY | (SEQ ID No: 41) |
| gb_QHR63270 | 601 | GTNTSNQVAVLYQDVNCTEVPVAIHADQLTPTWRVYSTGSNVFQTRAGCLIGAEHVNNSY | (SEQ ID No: 42) |
| gb_QHZ00399 | 601 | GTNTSNQVAVLYQDVNCTEVPVAIHADQLTPTWRVYSTGSNVFQTRAGCLIGAEHVNNSY | (SEQ ID No: 43) |
| dbj_BCA25644 | 601 | GTNTSNQVAVLYQDVNCTEVPVAIHADQLTPTWRVYSTGSNVFQTRAGCLIGAEHVNNSY | (SEQ ID No: 44) |
| dbj_BCA25654 | 601 | GTNTSNQVAVLYQDVNCTEVPVAIHADQLTPTWRVYSTGSNVFQTRAGCLIGAEHVNNSY | (SEQ ID No: 45) |
| gb_QHO62877 | 601 | GTNTSNQVAVLYQDVNCTEVPVAIHADQLTPTWRVYSTGSNVFQTRAGCLIGAEHVNNSY | (SEQ ID No: 46) |
| ref_YP_00972439 | 601 | GTNTSNQVAVLYQDVNCTEVPVAIHADQLTPTWRVYSTGSNVFQTRAGCLIGAEHVNNSY | (SEQ ID No: 47) |
| gb_QHW06039 | 601 | GTNTSNQVAVLYQDVNCTEVPVAIHADQLTPTWRVYSTGSNVFQTRAGCLIGAEHVNNSY | (SEQ ID No: 48) |
| gb_QHO62112 | 601 | GTNTSNQVAVLYQDVNCTEVPVAIHADQLTPTWRVYSTGSNVFQTRAGCLIGAEHVNNSY | (SEQ ID No: 49) |
| gb_QHQ71973 | 601 | GTNTSNQVAVLYQDVNCTEVPVAIHADQLTPTWRVYSTGSNVFQTRAGCLIGAEHVNNSY | (SEQ ID No: 50) |
| gb_QHW06049 | 601 | GTNTSNQVAVLYQDVNCTEVPVAIHADQLTPTWRVYSTGSNVFQTRAGCLIGAEHVNNSY | (SEQ ID No: 51) |
| gb_QHO60594 | 601 | GTNTSNQVAVLYQDVNCTEVPVAIHADQLTPTWRVYSTGSNVFQTRAGCLIGAEHVNNSY | (SEQ ID No: 52) |
| gb_QHN73810 | 601 | GTNTSNQVAVLYQDVNCTEVPVAIHADQLTPTWRVYSTGSNVFQTRAGCLIGAEHVNNSY | (SEQ ID No: 53) |
| gb_QHO62107 | 601 | GTNTSNQVAVLYQDVNCTEVPVAIHADQLTPTWRVYSTGSNVFQTRAGCLIGAEHVNNSY | (SEQ ID No: 54) |
| gb_QHQ82464 | 601 | GTNTSNQVAVLYQDVNCTEVPVAIHADQLTPTWRVYSTGSNVFQTRAGCLIGAEHVNNSY | (SEQ ID No: 55) |
| dbj_BBW89517 | 601 | GTNTSNQVAVLYQDVNCTEVPVAIHADQLTPTWRVYSTGSNVFQTRAGCLIGAEHVNNSY | (SEQ ID No: 56) |
| gb_QHU79204 | 601 | GTNTSNQVAVLYQDVNCTEVPVAIHADQLTPTWRVYSTGSNVFQTRAGCLIGAEHVNNSY | (SEQ ID No: 57) |
| gb_QHQ71963 | 601 | GTNTSNQVAVLYQDVNCTEVPVAIHADQLTPTWRVYSTGSNVFQTRAGCLIGAEHVNNSY | (SEQ ID No: 58) |
| gb_QHU79194 | 601 | GTNTSNQVAVLYQDVNCTEVPVAIHADQLTPTWRVYSTGSNVFQTRAGCLIGAEHVNNSY | (SEQ ID No: 59) |
| gb_QHN73795 | 601 | GTNTSNQVAVLYQDVNCTEVPVAIHADQLTPTWRVYSTGSNVFQTRAGCLIGAEHVNNSY | (SEQ ID No: 60) |
| gb_QHN73864 | 601 | GTNTSNQVAVLYQDVNCTEVPVAIHADQLTPTWRVYSTGSNVFQTRAGCLIGAEHVNNSY | (SEQ ID No: 61) |
| gb_QHD43416 | 601 | GTNTSNQVAVLYQDVNCTEVPVAIHADQLTPTWRVYSTGSNVFQTRAGCLIGAEHVNNSY | (SEQ ID No: 62) |
| gb_QHU36854 | 601 | GTNTSNQVAVLYQDVNCTEVPVAIHADQLTPTWRVYSTGSNVFQTRAGCLIGAEHVNNSY | (SEQ ID No: 63) |
| gb_QHU36844 | 601 | GTNTSNQVAVLYQDVNCTEVPVAIHADQLTPTWRVYSTGSNVFQTRAGCLIGAEHVNNSY | (SEQ ID No: 64) |
| gb_QHU36834 | 601 | GTNTSNQVAVLYQDVNCTEVPVAIHADQLTPTWRVYSTGSNVFQTRAGCLIGAEHVNNSY | (SEQ ID No: 65) |
| gb_QHU36824 | 601 | GTNTSNQVAVLYQDVNCTEVPVAIHADQLTPTWRVYSTGSNVFQTRAGCLIGAEHVNNSY | (SEQ ID No: 66) |
| consensus | 601 | GTNTSNQVAVLYQDVNCTEVPVAIHADQLTPTWRVYSTGSNVFQTRAGCLIGAEHVNNSY | (SEQ ID No: 67) |

*Fig. 2 (cont.)*

| Accession | Start | Sequence | SEQ ID |
|---|---|---|---|
| gb_QHW06059 | 661 | ECDIPIGAGICASYQTQTNSPRRARSVASQSIIAYTMSLGAENSVAYSNNSIAIPTNFTI | (SEQ ID No: 25) |
| gb_QHZ00379 | 661 | ECDIPIGAGICASYQTQTNSPRRARSVASQSIIAYTMSLGAENSVAYSNNSIAIPTNFTI | (SEQ ID No: 26) |
| gb_QHR84449 | 661 | ECDIPIGAGICASYQTQTNSPRRARSVASQSIIAYTMSLGAENSVAYSNNSIAIPTNFTI | (SEQ ID No: 27) |
| gb_QIA20044 | 661 | ECDIPIGAGICASYQTQTNSPRRARSVASQSIIAYTMSLGAENSVAYSNNSIAIPTNFTI | (SEQ ID No: 28) |
| gb_QHZ00358 | 661 | ECDIPIGAGICASYQTQTNSPRRARSVASQSIIAYTMSLGAENSVAYSNNSIAIPTNFTI | (SEQ ID No: 29) |
| dbj_BCA25664 | 661 | ECDIPIGAGICASYQTQTNSPRRARSVASQSIIAYTMSLGAENSVAYSNNSIAIPTNFTI | (SEQ ID No: 30) |
| gb_QHZ87582 | 661 | ECDIPIGAGICASYQTQTNSPRRARSVASQSIIAYTMSLGAENSVAYSNNSIAIPTNFTI | (SEQ ID No: 31) |
| dbj_BCA25674 | 661 | ECDIPIGAGICASYQTQTNSPRRARSVASQSIIAYTMSLGAENSVAYSNNSIAIPTNFTI | (SEQ ID No: 32) |
| gb_QHZ00389 | 661 | ECDIPIGAGICASYQTQTNSPRRARSVASQSIIAYTMSLGAENSVAYSNNSIAIPTNFTI | (SEQ ID No: 33) |
| gb_QHZ87592 | 661 | ECDIPIGAGICASYQTQTNSPRRARSVASQSIIAYTMSLGAENSVAYSNNSIAIPTNFTI | (SEQ ID No: 34) |
| gb_QIB84673 | 661 | ECDIPIGAGICASYQTQTNSPRRARSVASQSIIAYTMSLGAENSVAYSNNSIAIPTNFTI | (SEQ ID No: 35) |
| gb_QHR63260 | 661 | ECDIPIGAGICASYQTQTNSPRRARSVASQSIIAYTMSLGAENSVAYSNNSIAIPTNFTI | (SEQ ID No: 36) |
| gb_QIA98606 | 661 | ECDIPIGAGICASYQTQTNSPRRARSVASQSIIAYTMSLGAENSVAYSNNSIAIPTNFTI | (SEQ ID No: 37) |
| gb_QIA98596 | 661 | ECDIPIGAGICASYQTQTNSPRRARSVASQSIIAYTMSLGAENSVAYSNNSIAIPTNFTI | (SEQ ID No: 38) |
| gb_QHR63250 | 661 | ECDIPIGAGICASYQTQTNSPRRARSVASQSIIAYTMSLGAENSVAYSNNSIAIPTNFTI | (SEQ ID No: 39) |
| gb_QHR63280 | 661 | ECDIPIGAGICASYQTQTNSPRRARSVASQSIIAYTMSLGAENSVAYSNNSIAIPTNFTI | (SEQ ID No: 40) |
| gb_QHR63290 | 661 | ECDIPIGAGICASYQTQTNSPRRARSVASQSIIAYTMSLGAENSVAYSNNSIAIPTNFTI | (SEQ ID No: 41) |
| gb_QHR63270 | 661 | ECDIPIGAGICASYQTQTNSPRRARSVASQSIIAYTMSLGAENSVAYSNNSIAIPTNFTI | (SEQ ID No: 42) |
| gb_QHZ00399 | 661 | ECDIPIGAGICASYQTQTNSPRRARSVASQSIIAYTMSLGAENSVAYSNNSIAIPTNFTI | (SEQ ID No: 43) |
| dbj_BCA25644 | 661 | ECDIPIGAGICASYQTQTNSPRRARSVASQSIIAYTMSLGAENSVAYSNNSIAIPTNFTI | (SEQ ID No: 44) |
| dbj_BCA25654 | 661 | ECDIPIGAGICASYQTQTNSPRRARSVASQSIIAYTMSLGAENSVAYSNNSIAIPTNFTI | (SEQ ID No: 45) |
| gb_QHO62877 | 661 | ECDIPIGAGICASYQTQTNSPRRARSVASQSIIAYTMSLGAENSVAYSNNSIAIPTNFTI | (SEQ ID No: 46) |
| ref_YP_00972439 | 661 | ECDIPIGAGICASYQTQTNSPRRARSVASQSIIAYTMSLGAENSVAYSNNSIAIPTNFTI | (SEQ ID No: 47) |
| gb_QHW06039 | 661 | ECDIPIGAGICASYQTQTNSPRRARSVASQSIIAYTMSLGAENSVAYSNNSIAIPTNFTI | (SEQ ID No: 48) |
| gb_QHO62112 | 661 | ECDIPIGAGICASYQTQTNSPRRARSVASQSIIAYTMSLGAENSVAYSNNSIAIPTNFTI | (SEQ ID No: 49) |
| gb_QHU71973 | 661 | ECDIPIGAGICASYQTQTNSPRRARSVASQSIIAYTMSLGAENSVAYSNNSIAIPTNFTI | (SEQ ID No: 50) |
| gb_QHW06049 | 661 | ECDIPIGAGICASYQTQTNSPRRARSVASQSIIAYTMSLGAENSVAYSNNSIAIPTNFTI | (SEQ ID No: 51) |
| gb_QHO60594 | 661 | ECDIPIGAGICASYQTQTNSPRRARSVASQSIIAYTMSLGAENSVAYSNNSIAIPTNFTI | (SEQ ID No: 52) |
| gb_QHN73810 | 661 | ECDIPIGAGICASYQTQTNSPRRARSVASQSIIAYTMSLGAENSVAYSNNSIAIPTNFTI | (SEQ ID No: 53) |
| gb_QHO62107 | 661 | ECDIPIGAGICASYQTQTNSPRRARSVASQSIIAYTMSLGAENSVAYSNNSIAIPTNFTI | (SEQ ID No: 54) |
| gb_QHQ82464 | 661 | ECDIPIGAGICASYQTQTNSPRRARSVASQSIIAYTMSLGAENSVAYSNNSIAIPTNFTI | (SEQ ID No: 55) |
| dbj_BBW89517 | 661 | ECDIPIGAGICASYQTQTNSPRRARSVASQSIIAYTMSLGAENSVAYSNNSIAIPTNFTI | (SEQ ID No: 56) |
| gb_QHU79204 | 661 | ECDIPIGAGICASYQTQTNSPRRARSVASQSIIAYTMSLGAENSVAYSNNSIAIPTNFTI | (SEQ ID No: 57) |
| gb_QHU71963 | 661 | ECDIPIGAGICASYQTQTNSPRRARSVASQSIIAYTMSLGAENSVAYSNNSIAIPTNFTI | (SEQ ID No: 58) |
| gb_QHU79194 | 661 | ECDIPIGAGICASYQTQTNSPRRARSVASQSIIAYTMSLGAENSVAYSNNSIAIPTNFTI | (SEQ ID No: 59) |
| gb_QHN73795 | 661 | ECDIPIGAGICASYQTQTNSPRRARSVASQSIIAYTMSLGAENSVAYSNNSIAIPTNFTI | (SEQ ID No: 60) |
| gb_QHU36864 | 661 | ECDIPIGAGICASYQTQTNSPRRARSVASQSIIAYTMSLGAENSVAYSNNSIAIPTNFTI | (SEQ ID No: 61) |
| gb_QHD43416 | 661 | ECDIPIGAGICASYQTQTNSPRRARSVASQSIIAYTMSLGAENSVAYSNNSIAIPTNFTI | (SEQ ID No: 62) |

*Fig. 2 (cont.)*

| | | | |
|---|---|---|---|
| gb_QHU36854 | 661 | ECDIPIGAGICASYQTQTNSPRRARSVASQSIIAYTMSLGAENSVAYSNNSIAIPTNFTI | (SEQ ID No: 63) |
| gb_QHU36844 | 661 | ECDIPIGAGICASYQTQTNSPRRARSVASQSIIAYTMSLGAENSVAYSNNSIAIPTNFTI | (SEQ ID No: 64) |
| gb_QHU36834 | 661 | ECDIPIGAGICASYQTQTNSPRRARSVASQSIIAYTMSLGAENSVAYSNNSIAIPTNFTI | (SEQ ID No: 65) |
| gb_QHU36824 | 661 | ECDIPIGAGICASYQTQTNSPRRARSVASQSIIAYTMSLGAENSVAYSNNSIAIPTNFTI | (SEQ ID No: 66) |
| consensus | 661 | ECDIPIGAGICASYQTQTNSPRRARSVASQSIIAYTMSLGAENSVAYSNNSIAIPTNFTI | (SEQ ID No: 67) |
| gb_QHW06059 | 721 | SVTTEILPVSMTKTSVDCTMYICGDSTECSNLLLQYGSFCTQLNRALTGIAVEQDKNTQE | (SEQ ID No: 25) |
| gb_QHZ00379 | 721 | SVTTEILPVSMTKTSVDCTMYICGDSTECSNLLLQYGSFCTQLNRALTGIAVEQDKNTQE | (SEQ ID No: 26) |
| gb_QHR84449 | 721 | SVTTEILPVSMTKTSVDCTMYICGDSTECSNLLLQYGSFCTQLNRALTGIAVEQDKNTQE | (SEQ ID No: 27) |
| gb_QIA20044 | 721 | SVTTEILPVSMTKTSVDCTMYICGDSTECSNLLLQYGSFCTQLNRALTGIAVEQDKNTQE | (SEQ ID No: 28) |
| gb_QHZ00358 | 721 | SVTTEILPVSMTKTSVDCTMYICGDSTECSNLLLQYGSFCTQLNRALTGIAVEQDKNTQE | (SEQ ID No: 29) |
| dbj_BCA25664 | 721 | SVTTEILPVSMTKTSVDCTMYICGDSTECSNLLLQYGSFCTQLNRALTGIAVEQDKNTQE | (SEQ ID No: 30) |
| gb_QHZ87582 | 721 | SVTTEILPVSMTKTSVDCTMYICGDSTECSNLLLQYGSFCTQLNRALTGIAVEQDKNTQE | (SEQ ID No: 31) |
| dbj_BCA25674 | 721 | SVTTEILPVSMTKTSVDCTMYICGDSTECSNLLLQYGSFCTQLNRALTGIAVEQDKNTQE | (SEQ ID No: 32) |
| gb_QHZ00389 | 721 | SVTTEILPVSMTKTSVDCTMYICGDSTECSNLLLQYGSFCTQLNRALTGIAVEQDKNTQE | (SEQ ID No: 33) |
| gb_QHZ87592 | 721 | SVTTEILPVSMTKTSVDCTMYICGDSTECSNLLLQYGSFCTQLNRALTGIAVEQDKNTQE | (SEQ ID No: 34) |
| gb_QIB84673 | 721 | SVTTEILPVSMTKTSVDCTMYICGDSTECSNLLLQYGSFCTQLNRALTGIAVEQDKNTQE | (SEQ ID No: 35) |
| gb_QHR63260 | 721 | SVTTEILPVSMTKTSVDCTMYICGDSTECSNLLLQYGSFCTQLNRALTGIAVEQDKNTQE | (SEQ ID No: 36) |
| gb_QIA98606 | 721 | SVTTEILPVSMTKTSVDCTMYICGDSTECSNLLLQYGSFCTQLNRALTGIAVEQDKNTQE | (SEQ ID No: 37) |
| gb_QIA98596 | 721 | SVTTEILPVSMTKTSVDCTMYICGDSTECSNLLLQYGSFCTQLNRALTGIAVEQDKNTQE | (SEQ ID No: 38) |
| gb_QHR63250 | 721 | SVTTEILPVSMTKTSVDCTMYICGDSTECSNLLLQYGSFCTQLNRALTGIAVEQDKNTQE | (SEQ ID No: 39) |
| gb_QHR63280 | 721 | SVTTEILPVSMTKTSVDCTMYICGDSTECSNLLLQYGSFCTQLNRALTGIAVEQDKNTQE | (SEQ ID No: 40) |
| gb_QHR63290 | 721 | SVTTEILPVSMTKTSVDCTMYICGDSTECSNLLLQYGSFCTQLNRALTGIAVEQDKNTQE | (SEQ ID No: 41) |
| gb_QHR63270 | 721 | SVTTEILPVSMTKTSVDCTMYICGDSTECSNLLLQYGSFCTQLNRALTGIAVEQDKNTQE | (SEQ ID No: 42) |
| gb_QHZ00399 | 721 | SVTTEILPVSMTKTSVDCTMYICGDSTECSNLLLQYGSFCTQLNRALTGIAVEQDKNTQE | (SEQ ID No: 43) |
| dbj_BCA25644 | 721 | SVTTEILPVSMTKTSVDCTMYICGDSTECSNLLLQYGSFCTQLNRALTGIAVEQDKNTQE | (SEQ ID No: 44) |
| dbj_BCA25654 | 721 | SVTTEILPVSMTKTSVDCTMYICGDSTECSNLLLQYGSFCTQLNRALTGIAVEQDKNTQE | (SEQ ID No: 45) |
| gb_QHO62877 | 721 | SVTTEILPVSMTKTSVDCTMYICGDSTECSNLLLQYGSFCTQLNRALTGIAVEQDKNTQE | (SEQ ID No: 46) |
| ref_YP_00972439 | 721 | SVTTEILPVSMTKTSVDCTMYICGDSTECSNLLLQYGSFCTQLNRALTGIAVEQDKNTQE | (SEQ ID No: 47) |
| gb_QHW06039 | 721 | SVTTEILPVSMTKTSVDCTMYICGDSTECSNLLLQYGSFCTQLNRALTGIAVEQDKNTQE | (SEQ ID No: 48) |
| gb_QHO62112 | 721 | SVTTEILPVSMTKTSVDCTMYICGDSTECSNLLLQYGSFCTQLNRALTGIAVEQDKNTQE | (SEQ ID No: 49) |
| gb_QHQ71973 | 721 | SVTTEILPVSMTKTSVDCTMYICGDSTECSNLLLQYGSFCTQLNRALTGIAVEQDKNTQE | (SEQ ID No: 50) |
| gb_QHW06049 | 721 | SVTTEILPVSMTKTSVDCTMYICGDSTECSNLLLQYGSFCTQLNRALTGIAVEQDKNTQE | (SEQ ID No: 51) |
| gb_QHO60594 | 721 | SVTTEILPVSMTKTSVDCTMYICGDSTECSNLLLQYGSFCTQLNRALTGIAVEQDKNTQE | (SEQ ID No: 52) |
| gb_QHN73810 | 721 | SVTTEILPVSMTKTSVDCTMYICGDSTECSNLLLQYGSFCTQLNRALTGIAVEQDKNTQE | (SEQ ID No: 53) |
| gb_QHO62107 | 721 | SVTTEILPVSMTKTSVDCTMYICGDSTECSNLLLQYGSFCTQLNRALTGIAVEQDKNTQE | (SEQ ID No: 54) |
| gb_QHQ82464 | 721 | SVTTEILPVSMTKTSVDCTMYICGDSTECSNLLLQYGSFCTQLNRALTGIAVEQDKNTQE | (SEQ ID No: 55) |
| dbj_BBW89517 | 721 | SVTTEILPVSMTKTSVDCTMYICGDSTECSNLLLQYGSFCTQLNRALTGIAVEQDKNTQE | (SEQ ID No: 56) |

Fig. 2 (cont.)

| | | | |
|---|---|---|---|
| gb_QHU79204 | 721 | SVTTEILPVSMTKTSVDCTMYICGDSTECSNLLLQYGSFCTQLNRALTGIAVEQDKNTQE | (SEQ ID No: 57) |
| gb_QHQ71963 | 721 | SVTTEILPVSMTKTSVDCTMYICGDSTECSNLLLQYGSFCTQLNRALTGIAVEQDKNTQE | (SEQ ID No: 58) |
| gb_QHU79194 | 721 | SVTTEILPVSMTKTSVDCTMYICGDSTECSNLLLQYGSFCTQLNRALTGIAVEQDKNTQE | (SEQ ID No: 59) |
| gb_QHN73795 | 721 | SVTTEILPVSMTKTSVDCTMYICGDSTECSNLLLQYGSFCTQLNRALTGIAVEQDKNTQE | (SEQ ID No: 60) |
| gb_QHU36864 | 721 | SVTTEILPVSMTKTSVDCTMYICGDSTECSNLLLQYGSFCTQLNRALTGIAVEQDKNTQE | (SEQ ID No: 61) |
| gb_QHD43416 | 721 | SVTTEILPVSMTKTSVDCTMYICGDSTECSNLLLQYGSFCTQLNRALTGIAVEQDKNTQE | (SEQ ID No: 62) |
| gb_QHU36854 | 721 | SVTTEILPVSMTKTSVDCTMYICGDSTECSNLLLQYGSFCTQLNRALTGIAVEQDKNTQE | (SEQ ID No: 63) |
| gb_QHU36844 | 721 | SVTTEILPVSMTKTSVDCTMYICGDSTECSNLLLQYGSFCTQLNRALTGIAVEQDKNTQE | (SEQ ID No: 64) |
| gb_QHU36834 | 721 | SVTTEILPVSMTKTSVDCTMYICGDSTECSNLLLQYGSFCTQLNRALTGIAVEQDKNTQE | (SEQ ID No: 65) |
| gb_QHU36824 | 721 | SVTTEILPVSMTKTSVDCTMYICGDSTECSNLLLQYGSFCTQLNRALTGIAVEQDKNTQE | (SEQ ID No: 66) |
| consensus | 721 | SVTTEILPVSMTKTSVDCTMYICGDSTECSNLLLQYGSFCTQLNRALTGIAVEQDKNTQE | (SEQ ID No: 67) |
| gb_QHW06059 | 781 | VFAQVKQIYKTPPIKDFGGFNFSQILPDPSKPSKRSFIEDLLFNKVTLADAGFIKQYGDC | (SEQ ID No: 25) |
| gb_QHZ00379 | 781 | VFAQVKQIYKTPPIKDFGGFNFSQILPDPSKPSKRSFIEDLLFNKVTLADAGFIKQYGDC | (SEQ ID No: 26) |
| gb_QHR84449 | 781 | VFAQVKQIYKTPPIKDFGGFNFSQILPDPSKPSKRSFIEDLLFNKVTLADAGFIKQYGDC | (SEQ ID No: 27) |
| gb_QIA20044 | 781 | VFAQVKQIYKTPPIKDFGGFNFSQILPDPSKPSKRSFIEDLLFNKVTLADAGFIKQYGDC | (SEQ ID No: 28) |
| gb_QHZ00358 | 781 | VFAQVKQIYKTPPIKDFGGFNFSQILPDPSKPSKRSFIEDLLFNKVTLADAGFIKQYGDC | (SEQ ID No: 29) |
| dbj_BCA25664 | 781 | VFAQVKQIYKTPPIKDFGGFNFSQILPDPSKPSKRSFIEDLLFNKVTLADAGFIKQYGDC | (SEQ ID No: 30) |
| gb_QHZ87582 | 781 | VFAQVKQIYKTPPIKDFGGFNFSQILPDPSKPSKRSFIEDLLFNKVTLADAGFIKQYGDC | (SEQ ID No: 31) |
| dbj_BCA25674 | 781 | VFAQVKQIYKTPPIKDFGGFNFSQILPDPSKPSKRSFIEDLLFNKVTLADAGFIKQYGDC | (SEQ ID No: 32) |
| gb_QHZ00389 | 781 | VFAQVKQIYKTPPIKDFGGFNFSQILPDPSKPSKRSFIEDLLFNKVTLADAGFIKQYGDC | (SEQ ID No: 33) |
| gb_QHZ87592 | 781 | VFAQVKQIYKTPPIKDFGGFNFSQILPDPSKPSKRSFIEDLLFNKVTLADAGFIKQYGDC | (SEQ ID No: 34) |
| gb_QIB84673 | 781 | VFAQVKQIYKTPPIKDFGGFNFSQILPDPSKPSKRSFIEDLLFNKVTLADAGFIKQYGDC | (SEQ ID No: 35) |
| gb_QHR63260 | 781 | VFAQVKQIYKTPPIKDFGGFNFSQILPDPSKPSKRSFIEDLLFNKVTLADAGFIKQYGDC | (SEQ ID No: 36) |
| gb_QIA98606 | 781 | VFAQVKQIYKTPPIKDFGGFNFSQILPDPSKPSKRSFIEDLLFNKVTLADAGFIKQYGDC | (SEQ ID No: 37) |
| gb_QIA98596 | 781 | VFAQVKQIYKTPPIKDFGGFNFSQILPDPSKPSKRSFIEDLLFNKVTLADAGFIKQYGDC | (SEQ ID No: 38) |
| gb_QHR63250 | 781 | VFAQVKQIYKTPPIKDFGGFNFSQILPDPSKPSKRSFIEDLLFNKVTLADAGFIKQYGDC | (SEQ ID No: 39) |
| gb_QHR63280 | 781 | VFAQVKQIYKTPPIKDFGGFNFSQILPDPSKPSKRSFIEDLLFNKVTLADAGFIKQYGDC | (SEQ ID No: 40) |
| gb_QHR63290 | 781 | VFAQVKQIYKTPPIKDFGGFNFSQILPDPSKPSKRSFIEDLLFNKVTLADAGFIKQYGDC | (SEQ ID No: 41) |
| gb_QHR63270 | 781 | VFAQVKQIYKTPPIKDFGGFNFSQILPDPSKPSKRSFIEDLLFNKVTLADAGFIKQYGDC | (SEQ ID No: 42) |
| gb_QHZ00399 | 781 | VFAQVKQIYKTPPIKDFGGFNFSQILPDPSKPSKRSFIEDLLFNKVTLADAGFIKQYGDC | (SEQ ID No: 43) |
| dbj_BCA25644 | 781 | VFAQVKQIYKTPPIKDFGGFNFSQILPDPSKPSKRSFIEDLLFNKVTLADAGFIKQYGDC | (SEQ ID No: 44) |
| dbj_BCA25654 | 781 | VFAQVKQIYKTPPIKDFGGFNFSQILPDPSKPSKRSFIEDLLFNKVTLADAGFIKQYGDC | (SEQ ID No: 45) |
| gb_QHO62877 | 781 | VFAQVKQIYKTPPIKDFGGFNFSQILPDPSKPSKRSFIEDLLFNKVTLADAGFIKQYGDC | (SEQ ID No: 46) |
| ref_YP_00972439 | 781 | VFAQVKQIYKTPPIKDFGGFNFSQILPDPSKPSKRSFIEDLLFNKVTLADAGFIKQYGDC | (SEQ ID No: 47) |
| gb_QHW06039 | 781 | VFAQVKQIYKTPPIKDFGGFNFSQILPDPSKPSKRSFIEDLLFNKVTLADAGFIKQYGDC | (SEQ ID No: 48) |
| gb_QHO62112 | 781 | VFAQVKQIYKTPPIKDFGGFNFSQILPDPSKPSKRSFIEDLLFNKVTLADAGFIKQYGDC | (SEQ ID No: 49) |

*Fig. 2 (cont.)*

| | | | |
|---|---|---|---|
| gb_QHQ71973 | 781 | VFAQVKQIYKTPPIKDFGGFNFSQILPDPSKPSKRSFIEDLLFNKVTLADAGFIKQYGDC | (SEQ ID No: 50) |
| gb_QHW06049 | 781 | VFAQVKQIYKTPPIKDFGGFNFSQILPDPSKPSKRSFIEDLLFNKVTLADAGFIKQYGDC | (SEQ ID No: 51) |
| gb_QHO60594 | 781 | VFAQVKQIYKTPPIKDFGGFNFSQILPDPSKPSKRSFIEDLLFNKVTLADAGFIKQYGDC | (SEQ ID No: 52) |
| gb_QHN73810 | 781 | VFAQVKQIYKTPPIKDFGGFNFSQILPDPSKPSKRSFIEDLLFNKVTLADAGFIKQYGDC | (SEQ ID No: 53) |
| gb_QHO62107 | 781 | VFAQVKQIYKTPPIKDFGGFNFSQILPDPSKPSKRSFIEDLLFNKVTLADAGFIKQYGDC | (SEQ ID No: 54) |
| gb_QHQ82464 | 781 | VFAQVKQIYKTPPIKDFGGFNFSQILPDPSKPSKRSFIEDLLFNKVTLADAGFIKQYGDC | (SEQ ID No: 55) |
| dbj_BBW89517 | 781 | VFAQVKQIYKTPPIKDFGGFNFSQILPDPSKPSKRSFIEDLLFNKVTLADAGFIKQYGDC | (SEQ ID No: 56) |
| gb_QHU79204 | 781 | VFAQVKQIYKTPPIKDFGGFNFSQILPDPSKPSKRSFIEDLLFNKVTLADAGFIKQYGDC | (SEQ ID No: 57) |
| gb_QHQ71963 | 781 | VFAQVKQIYKTPPIKDFGGFNFSQILPDPSKPSKRSFIEDLLFNKVTLADAGFIKQYGDC | (SEQ ID No: 58) |
| gb_QHU79194 | 781 | VFAQVKQIYKTPPIKDFGGFNFSQILPDPSKPSKRSFIEDLLFNKVTLADAGFIKQYGDC | (SEQ ID No: 59) |
| gb_QHN73795 | 781 | VFAQVKQIYKTPPIKDFGGFNFSQILPDPSKPSKRSFIEDLLFNKVTLADAGFIKQYGDC | (SEQ ID No: 60) |
| gb_QHU36864 | 781 | VFAQVKQIYKTPPIKDFGGFNFSQILPDPSKPSKRSFIEDLLFNKVTLADAGFIKQYGDC | (SEQ ID No: 61) |
| gb_QHD43416 | 781 | VFAQVKQIYKTPPIKDFGGFNFSQILPDPSKPSKRSFIEDLLFNKVTLADAGFIKQYGDC | (SEQ ID No: 62) |
| gb_QHU36854 | 781 | VFAQVKQIYKTPPIKDFGGFNFSQILPDPSKPSKRSFIEDLLFNKVTLADAGFIKQYGDC | (SEQ ID No: 63) |
| gb_QHU36844 | 781 | VFAQVKQIYKTPPIKDFGGFNFSQILPDPSKPSKRSFIEDLLFNKVTLADAGFIKQYGDC | (SEQ ID No: 64) |
| gb_QHU36834 | 781 | VFAQVKQIYKTPPIKDFGGFNFSQILPDPSKPSKRSFIEDLLFNKVTLADAGFIKQYGDC | (SEQ ID No: 65) |
| gb_QHU36824 | 781 | VFAQVKQIYKTPPIKDFGGFNFSQILPDPSKPSKRSFIEDLLFNKVTLADAGFIKQYGDC | (SEQ ID No: 66) |
| consensus | 781 | VFAQVKQIYKTPPIKDFGGFNFSQILPDPSKPSKRSFIEDLLFNKVTLADAGFIKQYGDC | (SEQ ID No: 67) |
| gb_QHW06059 | 841 | LGDIAARDLICAQKFNGLTVLPPLLTDEMIAQYTSALLAGTITSGWTFGAGAALQIPFAM | (SEQ ID No: 25) |
| gb_QHZ00379 | 841 | LGDIAARDLICAQKFNGLTVLPPLLTDEMIAQYTSALLAGTITSGWTFGAGAALQIPFAM | (SEQ ID No: 26) |
| gb_QHR84449 | 841 | LGDIAARDLICAQKFNGLTVLPPLLTDEMIAQYTSALLAGTITSGWTFGAGAALQIPFAM | (SEQ ID No: 27) |
| gb_QIA20044 | 841 | LGDIAARDLICAQKFNGLTVLPPLLTDEMIAQYTSALLAGTITSGWTFGAGAALQIPFAM | (SEQ ID No: 28) |
| gb_QHZ00358 | 841 | LGDIAARDLICAQKFNGLTVLPPLLTDEMIAQYTSALLAGTITSGWTFGAGAALQIPFAM | (SEQ ID No: 29) |
| dbj_BCA25664 | 841 | LGDIAARDLICAQKFNGLTVLPPLLTDEMIAQYTSALLAGTITSGWTFGAGAALQIPFAM | (SEQ ID No: 30) |
| gb_QHZ87582 | 841 | LGDIAARDLICAQKFNGLTVLPPLLTDEMIAQYTSALLAGTITSGWTFGAGAALQIPFAM | (SEQ ID No: 31) |
| dbj_BCA25674 | 841 | LGDIAARDLICAQKFNGLTVLPPLLTDEMIAQYTSALLAGTITSGWTFGAGAALQIPFAM | (SEQ ID No: 32) |
| gb_QHZ00389 | 841 | LGDIAARDLICAQKFNGLTVLPPLLTDEMIAQYTSALLAGTITSGWTFGAGAALQIPFAM | (SEQ ID No: 33) |
| gb_QHZ87592 | 841 | LGDIAARDLICAQKFNGLTVLPPLLTDEMIAQYTSALLAGTITSGWTFGAGAALQIPFAM | (SEQ ID No: 34) |
| gb_QIB84673 | 841 | LGDIAARDLICAQKFNGLTVLPPLLTDEMIAQYTSALLAGTITSGWTFGAGAALQIPFAM | (SEQ ID No: 35) |
| gb_QHR63260 | 841 | LGDIAARDLICAQKFNGLTVLPPLLTDEMIAQYTSALLAGTITSGWTFGAGAALQIPFAM | (SEQ ID No: 36) |
| gb_QIA98606 | 841 | LGDIAARDLICAQKFNGLTVLPPLLTDEMIAQYTSALLAGTITSGWTFGAGAALQIPFAM | (SEQ ID No: 37) |
| gb_QIA98596 | 841 | LGDIAARDLICAQKFNGLTVLPPLLTDEMIAQYTSALLAGTITSGWTFGAGAALQIPFAM | (SEQ ID No: 38) |
| gb_QHR63250 | 841 | LGDIAARDLICAQKFNGLTVLPPLLTDEMIAQYTSALLAGTITSGWTFGAGAALQIPFAM | (SEQ ID No: 39) |
| gb_QHR63280 | 841 | LGDIAARDLICAQKFNGLTVLPPLLTDEMIAQYTSALLAGTITSGWTFGAGAALQIPFAM | (SEQ ID No: 40) |
| gb_QHR63290 | 841 | LGDIAARDLICAQKFNGLTVLPPLLTDEMIAQYTSALLAGTITSGWTFGAGAALQIPFAM | (SEQ ID No: 41) |
| gb_QHR63270 | 841 | LGDIAARDLICAQKFNGLTVLPPLLTDEMIAQYTSALLAGTITSGWTFGAGAALQIPFAM | (SEQ ID No: 42) |
| gb_QHZ00399 | 841 | LGDIAARDLICAQKFNGLTVLPPLLTDEMIAQYTSALLAGTITSGWTFGAGAALQIPFAM | (SEQ ID No: 43) |

Fig. 2 (cont.)

| | | |
|---|---|---|
| dbj_BCA25644 | 841 LGDIAARDLICAQKFNGLTVLPPLLTDEMIAQYTSALLAGTITSGWTFGAGAALQIPFAM | (SEQ ID No: 44) |
| dbj_BCA25654 | 841 LGDIAARDLICAQKFNGLTVLPPLLTDEMIAQYTSALLAGTITSGWTFGAGAALQIPFAM | (SEQ ID No: 45) |
| gb_QHO62877 | 841 LGDIAARDLICAQKFNGLTVLPPLLTDEMIAQYTSALLAGTITSGWTFGAGAALQIPFAM | (SEQ ID No: 46) |
| ref_YP_009724390 | 841 LGDIAARDLICAQKFNGLTVLPPLLTDEMIAQYTSALLAGTITSGWTFGAGAALQIPFAM | (SEQ ID No: 47) |
| gb_QHW06039 | 841 LGDIAARDLICAQKFNGLTVLPPLLTDEMIAQYTSALLAGTITSGWTFGAGAALQIPFAM | (SEQ ID No: 48) |
| gb_QHO62112 | 841 LGDIAARDLICAQKFNGLTVLPPLLTDEMIAQYTSALLAGTITSGWTFGAGAALQIPFAM | (SEQ ID No: 49) |
| gb_QHQ71973 | 841 LGDIAARDLICAQKFNGLTVLPPLLTDEMIAQYTSALLAGTITSGWTFGAGAALQIPFAM | (SEQ ID No: 50) |
| gb_QHW06049 | 841 LGDIAARDLICAQKFNGLTVLPPLLTDEMIAQYTSALLAGTITSGWTFGAGAALQIPFAM | (SEQ ID No: 51) |
| gb_QHO60594 | 841 LGDIAARDLICAQKFNGLTVLPPLLTDEMIAQYTSALLAGTITSGWTFGAGAALQIPFAM | (SEQ ID No: 52) |
| gb_QHN73810 | 841 LGDIAARDLICAQKFNGLTVLPPLLTDEMIAQYTSALLAGTITSGWTFGAGAALQIPFAM | (SEQ ID No: 53) |
| gb_QHO62107 | 841 LGDIAARDLICAQKFNGLTVLPPLLTDEMIAQYTSALLAGTITSGWTFGAGAALQIPFAM | (SEQ ID No: 54) |
| gb_QHQ82464 | 841 LGDIAARDLICAQKFNGLTVLPPLLTDEMIAQYTSALLAGTITSGWTFGAGAALQIPFAM | (SEQ ID No: 55) |
| dbj_BBW89517 | 841 LGDIAARDLICAQKFNGLTVLPPLLTDEMIAQYTSALLAGTITSGWTFGAGAALQIPFAM | (SEQ ID No: 56) |
| gb_QHU79204 | 841 LGDIAARDLICAQKFNGLTVLPPLLTDEMIAQYTSALLAGTITSGWTFGAGAALQIPFAM | (SEQ ID No: 57) |
| gb_QHQ71963 | 841 LGDIAARDLICAQKFNGLTVLPPLLTDEMIAQYTSALLAGTITSGWTFGAGAALQIPFAM | (SEQ ID No: 58) |
| gb_QHU79194 | 841 LGDIAARDLICAQKFNGLTVLPPLLTDEMIAQYTSALLAGTITSGWTFGAGAALQIPFAM | (SEQ ID No: 59) |
| gb_QHN73795 | 841 LGDIAARDLICAQKFNGLTVLPPLLTDEMIAQYTSALLAGTITSGWTFGAGAALQIPFAM | (SEQ ID No: 60) |
| gb_QHU36864 | 841 LGDIAARDLICAQKFNGLTVLPPLLTDEMIAQYTSALLAGTITSGWTFGAGAALQIPFAM | (SEQ ID No: 61) |
| gb_QHD43416 | 841 LGDIAARDLICAQKFNGLTVLPPLLTDEMIAQYTSALLAGTITSGWTFGAGAALQIPFAM | (SEQ ID No: 62) |
| gb_QHU36854 | 841 LGDIAARDLICAQKFNGLTVLPPLLTDEMIAQYTSALLAGTITSGWTFGAGAALQIPFAM | (SEQ ID No: 63) |
| gb_QHU36844 | 841 LGDIAARDLICAQKFNGLTVLPPLLTDEMIAQYTSALLAGTITSGWTFGAGAALQIPFAM | (SEQ ID No: 64) |
| gb_QHU36834 | 841 LGDIAARDLICAQKFNGLTVLPPLLTDEMIAQYTSALLAGTITSGWTFGAGAALQIPFAM | (SEQ ID No: 65) |
| gb_QHU36824 | 841 LGDIAARDLICAQKFNGLTVLPPLLTDEMIAQYTSALLAGTITSGWTFGAGAALQIPFAM | (SEQ ID No: 66) |
| consensus | 841 LGDIAARDLICAQKFNGLTVLPPLLTDEMIAQYTSALLAGTITSGWTFGAGAALQIPFAM | (SEQ ID No: 67) |
| gb_QHW06059 | 901 QMAYRFNGIGVTQNVLYENQKLIANQFNSAIGKIQDSLSSTASALGKLQDVVNQNAQALN | (SEQ ID No: 25) |
| gb_QHZ00379 | 901 QMAYRFNGIGVTQNVLYENQKLIANQFNSAIGKIQDSLSSTASALGKLQDVVNQNAQALN | (SEQ ID No: 26) |
| gb_QHR84449 | 901 QMAYRFNGIGVTQNVLYENQKLIANQFNSAIGKIQDSLSSTASALGKLQDVVNQNAQALN | (SEQ ID No: 27) |
| gb_QIA20044 | 901 QMAYRFNGIGVTQNVLYENQKLIANQFNSAIGKIQDSLSSTASALGKLQDVVNQNAQALN | (SEQ ID No: 28) |
| gb_QHZ00358 | 901 QMAYRFNGIGVTQNVLYENQKLIANQFNSAIGKIQDSLSSTASALGKLQDVVNQNAQALN | (SEQ ID No: 29) |
| dbj_BCA25664 | 901 QMAYRFNGIGVTQNVLYENQKLIANQFNSAIGKIQDSLSSTASALGKLQDVVNQNAQALN | (SEQ ID No: 30) |
| gb_QHZ87582 | 901 QMAYRFNGIGVTQNVLYENQKLIANQFNSAIGKIQDSLSSTASALGKLQDVVNQNAQALN | (SEQ ID No: 31) |
| dbj_BCA25674 | 901 QMAYRFNGIGVTQNVLYENQKLIANQFNSAIGKIQDSLSSTASALGKLQDVVNQNAQALN | (SEQ ID No: 32) |
| gb_QHZ00389 | 901 QMAYRFNGIGVTQNVLYENQKLIANQFNSAIGKIQDSLSSTASALGKLQDVVNQNAQALN | (SEQ ID No: 33) |
| gb_QHZ87592 | 901 QMAYRFNGIGVTQNVLYENQKLIANQFNSAIGKIQDSLSSTASALGKLQDVVNQNAQALN | (SEQ ID No: 34) |
| gb_QIB84673 | 901 QMAYRFNGIGVTQNVLYENQKLIANQFNSAIGKIQDSLSSTASALGKLQDVVNQNAQALN | (SEQ ID No: 35) |
| gb_QHR63260 | 901 QMAYRFNGIGVTQNVLYENQKLIANQFNSAIGKIQDSLSSTASALGKLQDVVNQNAQALN | (SEQ ID No: 36) |

*Fig. 2 (cont.)*

| | | | |
|---|---|---|---|
| gb_QIA98606 | 901 | QMAYRFNGIGVTQNVLYENQKLIANQFNSAIGKIQDSLSSTASALGKLQDVVNQNAQALN | (SEQ ID No: 37) |
| gb_QIA98596 | 901 | QMAYRFNGIGVTQNVLYENQKLIANQFNSAIGKIQDSLSSTASALGKLQDVVNQNAQALN | (SEQ ID No: 38) |
| gb_QHR63250 | 901 | QMAYRFNGIGVTQNVLYENQKLIANQFNSAIGKIQDSLSSTASALGKLQDVVNQNAQALN | (SEQ ID No: 39) |
| gb_QHR63280 | 901 | QMAYRFNGIGVTQNVLYENQKLIANQFNSAIGKIQDSLSSTASALGKLQDVVNQNAQALN | (SEQ ID No: 40) |
| gb_QHR63290 | 901 | QMAYRFNGIGVTQNVLYENQKLIANQFNSAIGKIQDSLSSTASALGKLQDVVNQNAQALN | (SEQ ID No: 41) |
| gb_QHZ00399 | 901 | QMAYRFNGIGVTQNVLYENQKLIANQFNSAIGKIQDSLSSTASALGKLQDVVNQNAQALN | (SEQ ID No: 42) |
| dbj_BCA25644 | 901 | QMAYRFNGIGVTQNVLYENQKLIANQFNSAIGKIQDSLSSTASALGKLQDVVNQNAQALN | (SEQ ID No: 43) |
| dbj_BCA25654 | 901 | QMAYRFNGIGVTQNVLYENQKLIANQFNSAIGKIQDSLSSTASALGKLQDVVNQNAQALN | (SEQ ID No: 44) |
| gb_QHO62877 | 901 | QMAYRFNGIGVTQNVLYENQKLIANQFNSAIGKIQDSLSSTASALGKLQDVVNQNAQALN | (SEQ ID No: 45) |
| ref_YP_00972439 | 901 | QMAYRFNGIGVTQNVLYENQKLIANQFNSAIGKIQDSLSSTASALGKLQDVVNQNAQALN | (SEQ ID No: 46) |
| gb_QHW06039 | 901 | QMAYRFNGIGVTQNVLYENQKLIANQFNSAIGKIQDSLSSTASALGKLQDVVNQNAQALN | (SEQ ID No: 47) |
| gb_QHO62112 | 901 | QMAYRFNGIGVTQNVLYENQKLIANQFNSAIGKIQDSLSSTASALGKLQDVVNQNAQALN | (SEQ ID No: 48) |
| gb_QHQ71973 | 901 | QMAYRFNGIGVTQNVLYENQKLIANQFNSAIGKIQDSLSSTASALGKLQDVVNQNAQALN | (SEQ ID No: 49) |
| gb_QHW06049 | 901 | QMAYRFNGIGVTQNVLYENQKLIANQFNSAIGKIQDSLSSTASALGKLQDVVNQNAQALN | (SEQ ID No: 50) |
| gb_QHO60594 | 901 | QMAYRFNGIGVTQNVLYENQKLIANQFNSAIGKIQDSLSSTASALGKLQDVVNQNAQALN | (SEQ ID No: 51) |
| gb_QHN73810 | 901 | QMAYRFNGIGVTQNVLYENQKLIANQFNSAIGKIQDSLSSTASALGKLQDVVNQNAQALN | (SEQ ID No: 52) |
| gb_QHO62107 | 901 | QMAYRFNGIGVTQNVLYENQKLIANQFNSAIGKIQDSLSSTASALGKLQDVVNQNAQALN | (SEQ ID No: 53) |
| gb_QHQ82464 | 901 | QMAYRFNGIGVTQNVLYENQKLIANQFNSAIGKIQDSLSSTASALGKLQDVVNQNAQALN | (SEQ ID No: 54) |
| dbj_BBW89517 | 901 | QMAYRFNGIGVTQNVLYENQKLIANQFNSAIGKIQDSLSSTASALGKLQDVVNQNAQALN | (SEQ ID No: 55) |
| gb_QHU79204 | 901 | QMAYRFNGIGVTQNVLYENQKLIANQFNSAIGKIQDSLSSTASALGKLQDVVNQNAQALN | (SEQ ID No: 56) |
| gb_QHQ71963 | 901 | QMAYRFNGIGVTQNVLYENQKLIANQFNSAIGKIQDSLSSTASALGKLQDVVNQNAQALN | (SEQ ID No: 57) |
| gb_QHU79194 | 901 | QMAYRFNGIGVTQNVLYENQKLIANQFNSAIGKIQDSLSSTASALGKLQDVVNQNAQALN | (SEQ ID No: 58) |
| gb_QHN73795 | 901 | QMAYRFNGIGVTQNVLYENQKLIANQFNSAIGKIQDSLSSTASALGKLQDVVNQNAQALN | (SEQ ID No: 59) |
| gb_QHU36864 | 901 | QMAYRFNGIGVTQNVLYENQKLIANQFNSAIGKIQDSLSSTASALGKLQDVVNQNAQALN | (SEQ ID No: 60) |
| gb_QHD43416 | 901 | QMAYRFNGIGVTQNVLYENQKLIANQFNSAIGKIQDSLSSTASALGKLQDVVNQNAQALN | (SEQ ID No: 61) |
| gb_QHU36854 | 901 | QMAYRFNGIGVTQNVLYENQKLIANQFNSAIGKIQDSLSSTASALGKLQDVVNQNAQALN | (SEQ ID No: 62) |
| gb_QHU36844 | 901 | QMAYRFNGIGVTQNVLYENQKLIANQFNSAIGKIQDSLSSTASALGKLQDVVNQNAQALN | (SEQ ID No: 63) |
| gb_QHU36834 | 901 | QMAYRFNGIGVTQNVLYENQKLIANQFNSAIGKIQDSLSSTASALGKLQDVVNQNAQALN | (SEQ ID No: 64) |
| gb_QHU36824 | 901 | QMAYRFNGIGVTQNVLYENQKLIANQFNSAIGKIQDSLSSTASALGKLQDVVNQNAQALN | (SEQ ID No: 65) |
| consensus | 901 | QMAYRFNGIGVTQNVLYENQKLIANQFNSAIGKIQDSLSSTASALGKLQDVVNQNAQALN | (SEQ ID No: 66) |
| | | | (SEQ ID No: 67) |
| gb_QHW06059 | 961 | TLVKQLSSNFGAISSVLNDILSRLDKVEAEVQIDRLITGRLQSLQTYVTQQLIRAAEIRA | (SEQ ID No: 25) |
| gb_QHZ00379 | 961 | TLVKQLSSNFGAISSVLNDILSRLDKVEAEVQIDRLITGRLQSLQTYVTQQLIRAAEIRA | (SEQ ID No: 26) |
| gb_QHR84449 | 961 | TLVKQLSSNFGAISSVLNDILSRLDKVEAEVQIDRLITGRLQSLQTYVTQQLIRAAEIRA | (SEQ ID No: 27) |
| gb_QIA20044 | 961 | TLVKQLSSNFGAISSVLNDILSRLDKVEAEVQIDRLITGRLQSLQTYVTQQLIRAAEIRA | (SEQ ID No: 28) |
| gb_QHZ00358 | 961 | TLVKQLSSNFGAISSVLNDILSRLDKVEAEVQIDRLITGRLQSLQTYVTQQLIRAAEIRA | (SEQ ID No: 29) |
| dbj_BCA25664 | 961 | TLVKQLSSNFGAISSVLNDILSRLDKVEAEVQIDRLITGRLQSLQTYVTQQLIRAAEIRA | (SEQ ID No: 30) |

| Accession | Pos | Sequence | SEQ ID |
|---|---|---|---|
| gb_QHW06059 | 1021 | SANLAATKMSECVLGQSKRVDFCGKGYHLMSFPQSAPHGVVFLHVTYVPAQEKNFTTAPA | (SEQ ID No: 25) |
| gb_QHZ00379 | 1021 | SANLAATKMSECVLGQSKRVDFCGKGYHLMSFPQSAPHGVVFLHVTYVPAQEKNFTTAPA | (SEQ ID No: 26) |
| gb_QHR84449 | 1021 | SANLAATKMSECVLGQSKRVDFCGKGYHLMSFPQSAPHGVVFLHVTYVPAQEKNFTTAPA | (SEQ ID No: 27) |
| gb_QIA20044 | 1021 | SANLAATKMSECVLGQSKRVDFCGKGYHLMSFPQSAPHGVVFLHVTYVPAQEKNFTTAPA | (SEQ ID No: 28) |
| gb_QHZ00358 | 1021 | SANLAATKMSECVLGQSKRVDFCGKGYHLMSFPQSAPHGVVFLHVTYVPAQEKNFTTAPA | (SEQ ID No: 29) |
| dbj_BCA25664 | 1021 | SANLAATKMSECVLGQSKRVDFCGKGYHLMSFPQSAPHGVVFLHVTYVPAQEKNFTTAPA | (SEQ ID No: 30) |
| gb_QHZ87582 | 1021 | SANLAATKMSECVLGQSKRVDFCGKGYHLMSFPQSAPHGVVFLHVTYVPAQEKNFTTAPA | (SEQ ID No: 31) |
| dbj_BCA25674 | 1021 | SANLAATKMSECVLGQSKRVDFCGKGYHLMSFPQSAPHGVVFLHVTYVPAQEKNFTTAPA | (SEQ ID No: 32) |
| gb_QHZ00389 | 1021 | SANLAATKMSECVLGQSKRVDFCGKGYHLMSFPQSAPHGVVFLHVTYVPAQEKNFTTAPA | (SEQ ID No: 33) |
| gb_QHZ87592 | 1021 | SANLAATKMSECVLGQSKRVDFCGKGYHLMSFPQSAPHGVVFLHVTYVPAQEKNFTTAPA | (SEQ ID No: 34) |
| gb_QIB84673 | 1021 | SANLAATKMSECVLGQSKRVDFCGKGYHLMSFPQSAPHGVVFLHVTYVPAQEKNFTTAPA | (SEQ ID No: 35) |
| gb_QHR63260 | 1021 | SANLAATKMSECVLGQSKRVDFCGKGYHLMSFPQSAPHGVVFLHVTYVPAQEKNFTTAPA | (SEQ ID No: 36) |
| gb_QIA98606 | 1021 | SANLAATKMSECVLGQSKRVDFCGKGYHLMSFPQSAPHGVVFLHVTYVPAQEKNFTTAPA | (SEQ ID No: 37) |
| gb_QIA98596 | 1021 | SANLAATKMSECVLGQSKRVDFCGKGYHLMSFPQSAPHGVVFLHVTYVPAQEKNFTTAPA | (SEQ ID No: 38) |
| gb_QHR63250 | 1021 | SANLAATKMSECVLGQSKRVDFCGKGYHLMSFPQSAPHGVVFLHVTYVPAQEKNFTTAPA | (SEQ ID No: 39) |
| gb_QHR63280 | 1021 | SANLAATKMSECVLGQSKRVDFCGKGYHLMSFPQSAPHGVVFLHVTYVPAQEKNFTTAPA | (SEQ ID No: 40) |
| gb_QHR63290 | 1021 | SANLAATKMSECVLGQSKRVDFCGKGYHLMSFPQSAPHGVVFLHVTYVPAQEKNFTTAPA | (SEQ ID No: 41) |
| gb_QHR63270 | 1021 | SANLAATKMSECVLGQSKRVDFCGKGYHLMSFPQSAPHGVVFLHVTYVPAQEKNFTTAPA | (SEQ ID No: 42) |
| gb_QHZ00399 | 1021 | SANLAATKMSECVLGQSKRVDFCGKGYHLMSFPQSAPHGVVFLHVTYVPAQEKNFTTAPA | (SEQ ID No: 43) |
| dbj_BCA25644 | 1021 | SANLAATKMSECVLGQSKRVDFCGKGYHLMSFPQSAPHGVVFLHVTYVPAQEKNFTTAPA | (SEQ ID No: 44) |
| dbj_BCA25654 | 1021 | SANLAATKMSECVLGQSKRVDFCGKGYHLMSFPQSAPHGVVFLHVTYVPAQEKNFTTAPA | (SEQ ID No: 45) |
| gb_QHO62877 | 1021 | SANLAATKMSECVLGQSKRVDFCGKGYHLMSFPQSAPHGVVFLHVTYVPAQEKNFTTAPA | (SEQ ID No: 46) |
| ref_YP_00972439 | 1021 | SANLAATKMSECVLGQSKRVDFCGKGYHLMSFPQSAPHGVVFLHVTYVPAQEKNFTTAPA | (SEQ ID No: 47) |
| gb_QHW06039 | 1021 | SANLAATKMSECVLGQSKRVDFCGKGYHLMSFPQSAPHGVVFLHVTYVPAQEKNFTTAPA | (SEQ ID No: 48) |
| gb_QHO62112 | 1021 | SANLAATKMSECVLGQSKRVDFCGKGYHLMSFPQSAPHGVVFLHVTYVPAQEKNFTTAPA | (SEQ ID No: 49) |
| gb_QHQ71973 | 1021 | SANLAATKMSECVLGQSKRVDFCGKGYHLMSFPQSAPHGVVFLHVTYVPAQEKNFTTAPA | (SEQ ID No: 50) |
| gb_QHW06049 | 1021 | SANLAATKMSECVLGQSKRVDFCGKGYHLMSFPQSAPHGVVFLHVTYVPAQEKNFTTAPA | (SEQ ID No: 51) |
| gb_QHO60594 | 1021 | SANLAATKMSECVLGQSKRVDFCGKGYHLMSFPQSAPHGVVFLHVTYVPAQEKNFTTAPA | (SEQ ID No: 52) |
| gb_QHN73810 | 1021 | SANLAATKMSECVLGQSKRVDFCGKGYHLMSFPQSAPHGVVFLHVTYVPAQEKNFTTAPA | (SEQ ID No: 53) |
| gb_QHO62107 | 1021 | SANLAATKMSECVLGQSKRVDFCGKGYHLMSFPQSAPHGVVFLHVTYVPAQEKNFTTAPA | (SEQ ID No: 54) |
| gb_QHQ82464 | 1021 | SANLAATKMSECVLGQSKRVDFCGKGYHLMSFPQSAPHGVVFLHVTYVPAQEKNFTTAPA | (SEQ ID No: 55) |
| dbj_BBW89517 | 1021 | SANLAATKMSECVLGQSKRVDFCGKGYHLMSFPQSAPHGVVFLHVTYVPAQEKNFTTAPA | (SEQ ID No: 56) |
| gb_QHU79204 | 1021 | SANLAATKMSECVLGQSKRVDFCGKGYHLMSFPQSAPHGVVFLHVTYVPAQEKNFTTAPA | (SEQ ID No: 57) |
| gb_QHU71963 | 1021 | SANLAATKMSECVLGQSKRVDFCGKGYHLMSFPQSAPHGVVFLHVTYVPAQEKNFTTAPA | (SEQ ID No: 58) |
| gb_QHU79194 | 1021 | SANLAATKMSECVLGQSKRVDFCGKGYHLMSFPQSAPHGVVFLHVTYVPAQEKNFTTAPA | (SEQ ID No: 59) |
| gb_QHN73795 | 1021 | SANLAATKMSECVLGQSKRVDFCGKGYHLMSFPQSAPHGVVFLHVTYVPAQEKNFTTAPA | (SEQ ID No: 60) |
| gb_QHU36864 | 1021 | SANLAATKMSECVLGQSKRVDFCGKGYHLMSFPQSAPHGVVFLHVTYVPAQEKNFTTAPA | (SEQ ID No: 61) |

Fig. 2 (cont.)

| Accession | Pos | Sequence | SEQ ID |
|---|---|---|---|
| gb_QHD43416 | 1021 | SANLAATKMSECVLGQSKRVDFCGKGYHLMSFPQSAPHGVVFLHVTYVPAQEKNFTTAPA | (SEQ ID No: 62) |
| gb_QHU36854 | 1021 | SANLAATKMSECVLGQSKRVDFCGKGYHLMSFPQSAPHGVVFLHVTYVPAQEKNFTTAPA | (SEQ ID No: 63) |
| gb_QHU36844 | 1021 | SANLAATKMSECVLGQSKRVDFCGKGYHLMSFPQSAPHGVVFLHVTYVPAQEKNFTTAPA | (SEQ ID No: 64) |
| gb_QHU36834 | 1021 | SANLAATKMSECVLGQSKRVDFCGKGYHLMSFPQSAPHGVVFLHVTYVPAQEKNFTTAPA | (SEQ ID No: 65) |
| gb_QHU36824 | 1021 | SANLAATKMSECVLGQSKRVDFCGKGYHLMSFPQSAPHGVVFLHVTYVPAQEKNFTTAPA | (SEQ ID No: 66) |
| consensus  | 1021 | SANLAATKMSECVLGQSKRVDFCGKGYHLMSFPQSAPHGVVFLHVTYVPAQEKNFTTAPA | (SEQ ID No: 67) |
| gb_QHW06059 | 1081 | ICHDGKAHFPREGVFVSNGTHWFVTQRNFYEPQIITTDNTFVSGNCDVVIGIVNNTVYDP | (SEQ ID No: 25) |
| gb_QHZ00379 | 1081 | ICHDGKAHFPREGVFVSNGTHWFVTQRNFYEPQIITTDNTFVSGNCDVVIGIVNNTVYDP | (SEQ ID No: 26) |
| gb_QHR84449 | 1081 | ICHDGKAHFPREGVFVSNGTHWFVTQRNFYEPQIITTDNTFVSGNCDVVIGIVNNTVYDP | (SEQ ID No: 27) |
| gb_QIA20044 | 1081 | ICHDGKAHFPREGVFVSNGTHWFVTQRNFYEPQIITTDNTFVSGNCDVVIGIVNNTVYDP | (SEQ ID No: 28) |
| gb_QHZ00358 | 1081 | ICHDGKAHFPREGVFVSNGTHWFVTQRNFYEPQIITTDNTFVSGNCDVVIGIVNNTVYDP | (SEQ ID No: 29) |
| dbj_BCA25664 | 1081 | ICHDGKAHFPREGVFVSNGTHWFVTQRNFYEPQIITTDNTFVSGNCDVVIGIVNNTVYDP | (SEQ ID No: 30) |
| gb_QHZ87582 | 1081 | ICHDGKAHFPREGVFVSNGTHWFVTQRNFYEPQIITTDNTFVSGNCDVVIGIVNNTVYDP | (SEQ ID No: 31) |
| dbj_BCA25674 | 1081 | ICHDGKAHFPREGVFVSNGTHWFVTQRNFYEPQIITTDNTFVSGNCDVVIGIVNNTVYDP | (SEQ ID No: 32) |
| gb_QHZ00389 | 1081 | ICHDGKAHFPREGVFVSNGTHWFVTQRNFYEPQIITTDNTFVSGNCDVVIGIVNNTVYDP | (SEQ ID No: 33) |
| gb_QHZ87592 | 1081 | ICHDGKAHFPREGVFVSNGTHWFVTQRNFYEPQIITTDNTFVSGNCDVVIGIVNNTVYDP | (SEQ ID No: 34) |
| gb_QIB84673 | 1081 | ICHDGKAHFPREGVFVSNGTHWFVTQRNFYEPQIITTDNTFVSGNCDVVIGIVNNTVYDP | (SEQ ID No: 35) |
| gb_QHR63260 | 1081 | ICHDGKAHFPREGVFVSNGTHWFVTQRNFYEPQIITTDNTFVSGNCDVVIGIVNNTVYDP | (SEQ ID No: 36) |
| gb_QIA98606 | 1081 | ICHDGKAHFPREGVFVSNGTHWFVTQRNFYEPQIITTDNTFVSGNCDVVIGIVNNTVYDP | (SEQ ID No: 37) |
| gb_QIA98596 | 1081 | ICHDGKAHFPREGVFVSNGTHWFVTQRNFYEPQIITTDNTFVSGNCDVVIGIVNNTVYDP | (SEQ ID No: 38) |
| gb_QHR63250 | 1081 | ICHDGKAHFPREGVFVSNGTHWFVTQRNFYEPQIITTDNTFVSGNCDVVIGIVNNTVYDP | (SEQ ID No: 39) |
| gb_QHR63280 | 1081 | ICHDGKAHFPREGVFVSNGTHWFVTQRNFYEPQIITTDNTFVSGNCDVVIGIVNNTVYDP | (SEQ ID No: 40) |
| gb_QHR63290 | 1081 | ICHDGKAHFPREGVFVSNGTHWFVTQRNFYEPQIITTDNTFVSGNCDVVIGIVNNTVYDP | (SEQ ID No: 41) |
| gb_QHR63270 | 1081 | ICHDGKAHFPREGVFVSNGTHWFVTQRNFYEPQIITTDNTFVSGNCDVVIGIVNNTVYDP | (SEQ ID No: 42) |
| gb_QHZ00399 | 1081 | ICHDGKAHFPREGVFVSNGTHWFVTQRNFYEPQIITTDNTFVSGNCDVVIGIVNNTVYDP | (SEQ ID No: 43) |
| dbj_BCA25644 | 1081 | ICHDGKAHFPREGVFVSNGTHWFVTQRNFYEPQIITTDNTFVSGNCDVVIGIVNNTVYDP | (SEQ ID No: 44) |
| dbj_BCA25654 | 1081 | ICHDGKAHFPREGVFVSNGTHWFVTQRNFYEPQIITTDNTFVSGNCDVVIGIVNNTVYDP | (SEQ ID No: 45) |
| gb_QHO62877 | 1081 | ICHDGKAHFPREGVFVSNGTHWFVTQRNFYEPQIITTDNTFVSGNCDVVIGIVNNTVYDP | (SEQ ID No: 46) |
| ref_YP_009972439 | 1081 | ICHDGKAHFPREGVFVSNGTHWFVTQRNFYEPQIITTDNTFVSGNCDVVIGIVNNTVYDP | (SEQ ID No: 47) |
| gb_QHW06039 | 1081 | ICHDGKAHFPREGVFVSNGTHWFVTQRNFYEPQIITTDNTFVSGNCDVVIGIVNNTVYDP | (SEQ ID No: 48) |
| gb_QHO62112 | 1081 | ICHDGKAHFPREGVFVSNGTHWFVTQRNFYEPQIITTDNTFVSGNCDVVIGIVNNTVYDP | (SEQ ID No: 49) |
| gb_QHQ71973 | 1081 | ICHDGKAHFPREGVFVSNGTHWFVTQRNFYEPQIITTDNTFVSGNCDVVIGIVNNTVYDP | (SEQ ID No: 50) |
| gb_QHW06049 | 1081 | ICHDGKAHFPREGVFVSNGTHWFVTQRNFYEPQIITTDNTFVSGNCDVVIGIVNNTVYDP | (SEQ ID No: 51) |
| gb_QHO60594 | 1081 | ICHDGKAHFPREGVFVSNGTHWFVTQRNFYEPQIITTDNTFVSGNCDVVIGIVNNTVYDP | (SEQ ID No: 52) |
| gb_QHN73810 | 1081 | ICHDGKAHFPREGVFVSNGTHWFVTQRNFYEPQIITTDNTFVSGNCDVVIGIVNNTVYDP | (SEQ ID No: 53) |
| gb_QHO62107 | 1081 | ICHDGKAHFPREGVFVSNGTHWFVTQRNFYEPQIITTDNTFVSGNCDVVIGIVNNTVYDP | (SEQ ID No: 54) |

| | | | |
|---|---|---|---|
| gb_QHW06039 | 1141 | LQPELDSFKEELDKYFKNHTSPDVDLGDISGINASVVNIQKEIDRLNEVAKNLNESLIDL | (SEQ ID NO: 48) |
| gb_QHO62112 | 1141 | LQPELDSFKEELDKYFKNHTSPDVDLGDISGINASVVNIQKEIDRLNEVAKNLNESLIDL | (SEQ ID NO: 49) |
| gb_QHQ71973 | 1141 | LQPELDSFKEELDKYFKNHTSPDVDLGDISGINASVVNIQKEIDRLNEVAKNLNESLIDL | (SEQ ID NO: 50) |
| gb_QHW06049 | 1141 | LQPELDSFKEELDKYFKNHTSPDVDLGDISGINASVVNIQKEIDRLNEVAKNLNESLIDL | (SEQ ID NO: 51) |
| gb_QHO60594 | 1141 | LQPELDSFKEELDKYFKNHTSPDVDLGDISGINASVVNIQKEIDRLNEVAKNLNESLIDL | (SEQ ID NO: 52) |
| gb_QHN73810 | 1141 | LQPELDSFKEELDKYFKNHTSPDVDLGDISGINASVVNIQKEIDRLNEVAKNLNESLIDL | (SEQ ID NO: 53) |
| gb_QHO62107 | 1141 | LQPELDSFKEELDKYFKNHTSPDVDLGDISGINASVVNIQKEIDRLNEVAKNLNESLIDL | (SEQ ID NO: 54) |
| gb_QHQ82464 | 1141 | LQPELDSFKEELDKYFKNHTSPDVDLGDISGINASVVNIQKEIDRLNEVAKNLNESLIDL | (SEQ ID NO: 55) |
| dbj_BBW89517 | 1141 | LQPELDSFKEELDKYFKNHTSPDVDLGDISGINASVVNIQKEIDRLNEVAKNLNESLIDL | (SEQ ID NO: 56) |
| gb_QHU79204 | 1141 | LQPELDSFKEELDKYFKNHTSPDVDLGDISGINASVVNIQKEIDRLNEVAKNLNESLIDL | (SEQ ID NO: 57) |
| gb_QHU71963 | 1141 | LQPELDSFKEELDKYFKNHTSPDVDLGDISGINASVVNIQKEIDRLNEVAKNLNESLIDL | (SEQ ID NO: 58) |
| gb_QHU79194 | 1141 | LQPELDSFKEELDKYFKNHTSPDVDLGDISGINASVVNIQKEIDRLNEVAKNLNESLIDL | (SEQ ID NO: 59) |
| gb_QHN73795 | 1141 | LQPELDSFKEELDKYFKNHTSPDVDLGDISGINASVVNIQKEIDRLNEVAKNLNESLIDL | (SEQ ID NO: 60) |
| gb_QHU36864 | 1141 | LQPELDSFKEELDKYFKNHTSPDVDLGDISGINASVVNIQKEIDRLNEVAKNLNESLIDL | (SEQ ID NO: 61) |
| gb_QHD43416 | 1141 | LQPELDSFKEELDKYFKNHTSPDVDLGDISGINASVVNIQKEIDRLNEVAKNLNESLIDL | (SEQ ID NO: 62) |
| gb_QHU36854 | 1141 | LQPELDSFKEELDKYFKNHTSPDVDLGDISGINASVVNIQKEIDRLNEVAKNLNESLIDL | (SEQ ID NO: 63) |
| gb_QHU36844 | 1141 | LQPELDSFKEELDKYFKNHTSPDVDLGDISGINASVVNIQKEIDRLNEVAKNLNESLIDL | (SEQ ID NO: 64) |
| gb_QHU36834 | 1141 | LQPELDSFKEELDKYFKNHTSPDVDLGDISGINASVVNIQKEIDRLNEVAKNLNESLIDL | (SEQ ID NO: 65) |
| gb_QHU36824 | 1141 | LQPELDSFKEELDKYFKNHTSPDVDLGDISGINASVVNIQKEIDRLNEVAKNLNESLIDL | (SEQ ID NO: 66) |
| consensus | 1141 | LQPELDSFKEELDKYFKNHTSPDVDLGDISGINASVVNIQKEIDRLNEVAKNLNESLIDL | (SEQ ID NO: 67) |

| | | | |
|---|---|---|---|
| gb_QHW06059 | 1201 | QELGKYEQYIKWPWYIWLGFIAGLIAIVMVTIMLCCMTSCCSCLKGCCSCGSCCKFDEDD | (SEQ ID NO: 25) |
| gb_QHZ00379 | 1201 | QELGKYEQYIKWPWYIWLGFIAGLIAIVMVTIMLCCMTSCCSCLKGCCSCGSCCKFDEDD | (SEQ ID NO: 26) |
| gb_QHR84449 | 1201 | QELGKYEQYIKWPWYIWLGFIAGLIAIVMVTIMLCCMTSCCSCLKGCCSCGSCCKFDEDD | (SEQ ID NO: 27) |
| gb_QIA20044 | 1201 | QELGKYEQYIKWPWYIWLGFIAGLIAIVMVTIMLCCMTSCCSCLKGCCSCGSCCKFDEDD | (SEQ ID NO: 28) |
| gb_QHZ00358 | 1201 | QELGKYEQYIKWPWYIWLGFIAGLIAIVMVTIMLCCMTSCCSCLKGCCSCGSCCKFDEDD | (SEQ ID NO: 29) |
| dbj_BCA25664 | 1201 | QELGKYEQYIKWPWYIWLGFIAGLIAIVMVTIMLCCMTSCCSCLKGCCSCGSCCKFDEDD | (SEQ ID NO: 30) |
| gb_QHZ87582 | 1201 | QELGKYEQYIKWPWYIWLGFIAGLIAIVMVTIMLCCMTSCCSCLKGCCSCGSCCKFDEDD | (SEQ ID NO: 31) |
| dbj_BCA25674 | 1201 | QELGKYEQYIKWPWYIWLGFIAGLIAIVMVTIMLCCMTSCCSCLKGCCSCGSCCKFDEDD | (SEQ ID NO: 32) |
| gb_QHZ00389 | 1201 | QELGKYEQYIKWPWYIWLGFIAGLIAIVMVTIMLCCMTSCCSCLKGCCSCGSCCKFDEDD | (SEQ ID NO: 33) |
| gb_QHZ87592 | 1201 | QELGKYEQYIKWPWYIWLGFIAGLIAIVMVTIMLCCMTSCCSCLKGCCSCGSCCKFDEDD | (SEQ ID NO: 34) |
| gb_QIB84673 | 1201 | QELGKYEQYIKWPWYIWLGFIAGLIAIVMVTIMLCCMTSCCSCLKGCCSCGSCCKFDEDD | (SEQ ID NO: 35) |
| gb_QHR63260 | 1201 | QELGKYEQYIKWPWYIWLGFIAGLIAIVMVTIMLCCMTSCCSCLKGCCSCGSCCKFDEDD | (SEQ ID NO: 36) |
| gb_QIA98606 | 1201 | QELGKYEQYIKWPWYIWLGFIAGLIAIVMVTIMLCCMTSCCSCLKGCCSCGSCCKFDEDD | (SEQ ID NO: 37) |
| gb_QIA98596 | 1201 | QELGKYEQYIKWPWYIWLGFIAGLIAIVMVTIMLCCMTSCCSCLKGCCSCGSCCKFDEDD | (SEQ ID NO: 38) |
| gb_QHR63250 | 1201 | QELGKYEQYIKWPWYIWLGFIAGLIAIVMVTIMLCCMTSCCSCLKGCCSCGSCCKFDEDD | (SEQ ID NO: 39) |
| gb_QHR63280 | 1201 | QELGKYEQYIKWPWYIWLGFIAGLIAIVMVTIMLCCMTSCCSCLKGCCSCGSCCKFDEDD | (SEQ ID NO: 40) |
| gb_QHR63290 | 1201 | QELGKYEQYIKWPWYIWLGFIAGLIAIVMVTIMLCCMTSCCSCLKGCCSCGSCCKFDEDD | (SEQ ID NO: 41) |

*Fig. 2 (cont.)*

| Accession | Pos | Sequence | SEQ ID NO |
|---|---|---|---|
| gb_QHR63270 | 1201 | QELGKYEQYIKWPWYIWLGFIAGLIAIVMVTIMLCCMTSCCSCLKGCCSCGSCCKFDEDD | |
| gb_QHZ00399 | 1201 | QELGKYEQYIKWPWYIWLGFIAGLIAIVMVTIMLCCMTSCCSCLKGCCSCGSCCKFDEDD | |
| dbj_BCA25644 | 1201 | QELGKYEQYIKWPWYIWLGFIAGLIAIVMVTIMLCCMTSCCSCLKGCCSCGSCCKFDEDD | |
| dbj_BCA25654 | 1201 | QELGKYEQYIKWPWYIWLGFIAGLIAIVMVTIMLCCMTSCCSCLKGCCSCGSCCKFDEDD | |
| gb_QHO62877 | 1201 | QELGKYEQYIKWPWYIWLGFIAGLIAIVMVTIMLCCMTSCCSCLKGCCSCGSCCKFDEDD | |
| ref_YP_009972439 | 1201 | QELGKYEQYIKWPWYIWLGFIAGLIAIVMVTIMLCCMTSCCSCLKGCCSCGSCCKFDEDD | |
| gb_QHW06039 | 1201 | QELGKYEQYIKWPWYIWLGFIAGLIAIVMVTIMLCCMTSCCSCLKGCCSCGSCCKFDEDD | |
| gb_QHO62112 | 1201 | QELGKYEQYIKWPWYIWLGFIAGLIAIVMVTIMLCCMTSCCSCLKGCCSCGSCCKFDEDD | |
| gb_QHQ71973 | 1201 | QELGKYEQYIKWPWYIWLGFIAGLIAIVMVTIMLCCMTSCCSCLKGCCSCGSCCKFDEDD | |
| gb_QHW06049 | 1201 | QELGKYEQYIKWPWYIWLGFIAGLIAIVMVTIMLCCMTSCCSCLKGCCSCGSCCKFDEDD | |
| gb_QHO60594 | 1201 | QELGKYEQYIKWPWYIWLGFIAGLIAIVMVTIMLCCMTSCCSCLKGCCSCGSCCKFDEDD | |
| gb_QHN73810 | 1201 | QELGKYEQYIKWPWYIWLGFIAGLIAIVMVTIMLCCMTSCCSCLKGCCSCGSCCKFDEDD | |
| gb_QHO62107 | 1201 | QELGKYEQYIKWPWYIWLGFIAGLIAIVMVTIMLCCMTSCCSCLKGCCSCGSCCKFDEDD | |
| gb_QHQ82464 | 1201 | QELGKYEQYIKWPWYIWLGFIAGLIAIVMVTIMLCCMTSCCSCLKGCCSCGSCCKFDEDD | |
| dbj_BBW89517 | 1201 | QELGKYEQYIKWPWYIWLGFIAGLIAIVMVTIMLCCMTSCCSCLKGCCSCGSCCKFDEDD | |
| gb_QHU79204 | 1201 | QELGKYEQYIKWPWYIWLGFIAGLIAIVMVTIMLCCMTSCCSCLKGCCSCGSCCKFDEDD | |
| gb_QHQ71963 | 1201 | QELGKYEQYIKWPWYIWLGFIAGLIAIVMVTIMLCCMTSCCSCLKGCCSCGSCCKFDEDD | |
| gb_QHU79194 | 1201 | QELGKYEQYIKWPWYIWLGFIAGLIAIVMVTIMLCCMTSCCSCLKGCCSCGSCCKFDEDD | |
| gb_QHN73795 | 1201 | QELGKYEQYIKWPWYIWLGFIAGLIAIVMVTIMLCCMTSCCSCLKGCCSCGSCCKFDEDD | |
| gb_QHU36864 | 1201 | QELGKYEQYIKWPWYIWLGFIAGLIAIVMVTIMLCCMTSCCSCLKGCCSCGSCCKFDEDD | |
| gb_QHD43416 | 1201 | QELGKYEQYIKWPWYIWLGFIAGLIAIVMVTIMLCCMTSCCSCLKGCCSCGSCCKFDEDD | |
| gb_QHU36854 | 1201 | QELGKYEQYIKWPWYIWLGFIAGLIAIVMVTIMLCCMTSCCSCLKGCCSCGSCCKFDEDD | |
| gb_QHU36844 | 1201 | QELGKYEQYIKWPWYIWLGFIAGLIAIVMVTIMLCCMTSCCSCLKGCCSCGSCCKFDEDD | |
| gb_QHU36834 | 1201 | QELGKYEQYIKWPWYIWLGFIAGLIAIVMVTIMLCCMTSCCSCLKGCCSCGSCCKFDEDD | |
| gb_QHU36824 | 1201 | QELGKYEQYIKWPWYIWLGFIAGLIAIVMVTIMLCCMTSCCSCLKGCCSCGSCCKFDEDD | |
| consensus | 1201 | QELGKYEQYIKWPWYIWLGFIAGLIAIVMVTIMLCCMTSCCSCLKGCCSCGSCCKFDEDD | |
| gb_QHW06059 | 1261 | SEPVLKGVKLHYT | (SEQ ID No: 25) |
| gb_QHZ00379 | 1261 | SEPVLKGVKLHYT | (SEQ ID No: 26) |
| gb_QHR84449 | 1261 | SEPVLKGVKLHYT | (SEQ ID No: 27) |
| gb_QIA20044 | 1261 | SEPVLKGVKLHYT | (SEQ ID No: 28) |
| gb_QHZ00358 | 1261 | SEPVLKGVKLHYT | (SEQ ID No: 29) |
| dbj_BCA25664 | 1261 | SEPVLKGVKLHYT | (SEQ ID No: 30) |
| gb_QHZ87582 | 1261 | SEPVLKGVKLHYT | (SEQ ID No: 31) |
| dbj_BCA25674 | 1261 | SEPVLKGVKLHYT | (SEQ ID No: 32) |
| gb_QHZ00389 | 1261 | SEPVLKGVKLHYT | (SEQ ID No: 33) |
| gb_QHZ87592 | 1261 | SEPVLKGVKLHYT | (SEQ ID No: 34) |
| gb_QIB84673 | 1261 | SEPVLKGVKLHYT | (SEQ ID No: 35) |

SEQ ID Nos for first block: 42–67 (corresponding to the 26 rows of the first alignment block, including consensus).

Fig. 2 (cont.)

| | | | |
|---|---|---|---|
| gb_QHR63260 | 1261 | SEPVLKGVKLHYT | (SEQ ID No: 36) |
| gb_QIA98606 | 1261 | SEPVLKGVKLHYT | (SEQ ID No: 37) |
| gb_QIA98596 | 1261 | SEPVLKGVKLHYT | (SEQ ID No: 38) |
| gb_QHR63250 | 1261 | SEPVLKGVKLHYT | (SEQ ID No: 39) |
| gb_QHR63280 | 1261 | SEPVLKGVKLHYT | (SEQ ID No: 40) |
| gb_QHR63290 | 1261 | SEPVLKGVKLHYT | (SEQ ID No: 41) |
| gb_QHR63270 | 1261 | SEPVLKGVKLHYT | (SEQ ID No: 42) |
| gb_QHZ00399 | 1261 | SEPVLKGVKLHYT | (SEQ ID No: 43) |
| dbj_BCA25644 | 1261 | SEPVLKGVKLHYT | (SEQ ID No: 44) |
| dbj_BCA25654 | 1261 | SEPVLKGVKLHYT | (SEQ ID No: 45) |
| gb_QHO62877 | 1261 | SEPVLKGVKLHYT | (SEQ ID No: 46) |
| ref_YP_00972439 | 1261 | SEPVLKGVKLHYT | (SEQ ID No: 47) |
| gb_QHW06039 | 1261 | SEPVLKGVKLHYT | (SEQ ID No: 48) |
| gb_QHO62112 | 1261 | SEPVLKGVKLHYT | (SEQ ID No: 49) |
| gb_QHQ711973 | 1261 | SEPVLKGVKLHYT | (SEQ ID No: 50) |
| gb_QHW06049 | 1261 | SEPVLKGVKLHYT | (SEQ ID No: 51) |
| gb_QHO60594 | 1261 | SEPVLKGVKLHYT | (SEQ ID No: 52) |
| gb_QHN73810 | 1261 | SEPVLKGVKLHYT | (SEQ ID No: 53) |
| gb_QHO62107 | 1261 | SEPVLKGVKLHYT | (SEQ ID No: 54) |
| gb_QHQ82464 | 1261 | SEPVLKGVKLHYT | (SEQ ID No: 55) |
| dbj_BBW89517 | 1261 | SEPVLKGVKLHYT | (SEQ ID No: 56) |
| gb_QHU79204 | 1261 | SEPVLKGVKLHYT | (SEQ ID No: 57) |
| gb_QHQ711963 | 1261 | SEPVLKGVKLHYT | (SEQ ID No: 58) |
| gb_QHU79194 | 1261 | SEPVLKGVKLHYT | (SEQ ID No: 59) |
| gb_QHN73795 | 1261 | SEPVLKGVKLHYT | (SEQ ID No: 60) |
| gb_QHU368864 | 1261 | SEPVLKGVKLHYT | (SEQ ID No: 61) |
| gb_QHD43416 | 1261 | SEPVLKGVKLHYT | (SEQ ID No: 62) |
| gb_QHU368854 | 1261 | SEPVLKGVKLHYT | (SEQ ID No: 63) |
| gb_QHU368844 | 1261 | SEPVLKGVKLHYT | (SEQ ID No: 64) |
| gb_QHU368834 | 1261 | SEPVLKGVKLHYT | (SEQ ID No: 65) |
| gb_QHU368824 | 1261 | SEPVLKGVKLHYT | (SEQ ID No: 66) |
| consensus | 1261 | SEPVLKGVKLHYT | (SEQ ID No: 67) |

SARS-CoV-2 S Proteins Inserted in VSV Genomic Clone 4 kbp gene

| S1 | S2 |

Amino acids: 1, 100, 200, 300, 400, 500, 600, 700, 800, 900, 1000, 1100, 1200, 1300

SS — Furin — MPER — TM — CT

SARS-CoV-2 Spike constructs

1. LEADER SEQUENCE 1 — YEQYIK — WPWYIW — LGFIAGLIAIVMVTIML — CCMTSCCSCLKGCCSCGSCCKFDEDDSEPVLKGVKLHYT
   MPER SEQ ID NO: 163   TM SEQ ID NO: 164   CT SEQ ID NO: 165
   AMINO ACID NOS: 1187-1273 OF S_WILD-TYPE SEQ ID NO: 1

2. LEADER SEQUENCE 1 — YEQYIK — WPWYIW — LGFIAGLIAIVMVTIML — CCMTSCCS
   MPER SEQ ID NO: 163   TM SEQ ID NO: 164   CT SEQ ID NO: 171
   AMINO ACID NOS: 1187-1242 OF S_ΔCT31 SEQ ID NO: 4

3. LEADER SEQUENCE 1 — YEQYIK — WPWYIW — LGFIAGLIAIVMVTIML — RVGIYLCIKLKHTKKRQIYTDIEMNRLGK
   MPER SEQ ID NO: 163   TM SEQ ID NO: 164   SEQ ID NO: 173
   AMINO ACID NOS: 1187-1263 OF S_VSV-GCT SEQ ID NO: 7

4. LEADER SEQUENCE 1 — YEQYIK — WPWYIW — SSIASFFFIIGLIIGLFLVL — RVGIYLCIKLKHTKKRQIYTDIEMNRLGK
   MPER SEQ ID NO: 163   SEQ ID NO: 175   SEQ ID NO: 173
   AMINO ACID NOS: 1187-1266 OF S_VSV-Gtmct SEQ ID NO: 10

5. LEADER SEQUENCE 1 — YEQYIK — SSIASFFFIIGLIIGLFLVL — RVGIYLCIKLKHTKKRQIYTDIEMNRLGK
   MPER SEQ ID NO: 177   SEQ ID NO: 175   SEQ ID NO: 173
   AMINO ACID NOS: 1187-1260 OF S_VSV-Gtm-ctΔmper6 SEQ ID NO: 13

SARS-CoV-2 Spike constructs

6. LEADER SEQUENCE 1 — MPER SEQ ID NO: 163 YEQYIK WPWYIW — TM SEQ ID NO: 164 LGFIAGLIAIVMVTIML — CT SEQ ID NO: 179 CCMTSCCSCLKGCCSCGS
   AMINO ACID NOS: 1187-1252 OF S_Δ21 SEQ ID NO: 16

7. LEADER SEQUENCE 1 — MPER SEQ ID NO: 177 YEQYIK WPWYIW — TM SEQ ID NO: 181 LGFIAGLIAIVMVTIML — CT SEQ ID NO: 182 CCMTSCCSCLKGCCSCGSCCRVGIYLCIKLKHTKKRQIYTDIEMNRLGK
   SEQ ID NO: 173
   AMINO ACID NOS: 1187-1283 OF S_ΔCT19-Gct SEQ ID NO: 19

8. LEADER SEQUENCE 1 — MPER SEQ ID NO: 177 YEQYIK WPWYIW — TM SEQ ID NO: 181 LGFIAGLIAIVMVTIML — CT SEQ ID NO: 182 CCMTSCCSCLKGCCSCGSCCKLKHTKKRQIYTDIEMNRLGK
   SEQ ID NO: 185
   AMINO ACID NOS: 1187-1275 OF S_ΔCT19-Gct21 SEQ ID NO: 22

VSV-G

LEADER SEQUENCE 2 — SEQ ID NO: 175 SSIASFFFTIGLIIGLFLVL ... RVGIYLCIKLKHTKKRQIYTDIEMNRLGK
SEQ ID NO: 185
SEQ ID NO: 191 WHICH IS A SEGMENT OF VSV-G

Leader sequence 1 in SARS-CoV-2 Spike constructs SEQ ID NO: 189 – NEVAKNLNESLIDLGELGK
Leader sequence 2 in VSV-G SEQ ID NO: 190 – TLFFGDTGLSKNPIEFVEGWFSSWK

```
Score = 4603 bits (11938), Expect = 0.0, Method: Compositional matrix
adjust. Identities = 3819/3822 (99%), Positives = 3819/3822 (99%),
Gaps = 0/3822 (0%)
```
Query is the codon-optimized, wild-type SARS-CoV-2 S gene in VSVΔG-
SARS-CoV-2 (SEQ ID NO: 159).
Sbjct is the nucleotide sequence of the SARS-CoV-2 S gene in rVSVΔG-
SARS-CoV-2 clone MB1 (SEQ ID NO: 150).

```
Query    1    ATGTTCGTGTTCCTGGTGCTATTACCTCTGGTTTCGTCTCAATGCGTAAACCTTACAACT    60
              ATGTTCGTGTTCCTGGTGCTATTACCTCTGGTTTCGTCTCAATGCGTAAACCTTACAACT
Sbjct    1    ATGTTCGTGTTCCTGGTGCTATTACCTCTGGTTTCGTCTCAATGCGTAAACCTTACAACT    60

Query    61   AGAACTCAGCTTCCTCCAGCATACACAAATTCCTTCACTCGCGGAGTGTATTATCCTGAT   120
              AGAACTCAGCTTCCTCCAGCATACACAAATTCCTTCACTCGCGGAGTGTATTATCCTGAT
Sbjct    61   AGAACTCAGCTTCCTCCAGCATACACAAATTCCTTCACTCGCGGAGTGTATTATCCTGAT   120

Query    121  AAGGTCTTTCGATCATCAGTGTTGCATTCCACCCAGGATTGTTTCTCCCGTTCTTTTCA   180
              AAGGTCTTTCGATCATCAGTGTTGCATTCCACCCAGGATTGTTTCTCCCGTTCTTTTCA
Sbjct    121  AAGGTCTTTCGATCATCAGTGTTGCATTCCACCCAGGATTGTTTCTCCCGTTCTTTTCA   180

Query    161  AATGTAACTTGGTTCCATGCTATACATGTTTCCGGAACCAATGGAACAAAGAGATTTGAT   240
              AATGTAACTTGGTTCCATGCTATACATGTTTCCGGAACCAATGGAACAAAGAGATTTGAT
Sbjct    181  AATGTAACTTGGTTCCATGCTATACATGTTTCCGGAACCAATGGAACAAAGAGATTTGAT   240

Query    241  AACCCAGTGTTACCATTTAACGACGGAGTTTATTTCGCATCAACTGAGAAATCCAATATC   300
              AACCCAGTGTTACCATTTAACGACGGAGTTTATTTCGCATCAACTGAGAAATCCAATATC
Sbjct    241  AACCCAGTGTTACCATTTAACGACGGAGTTTATTTCGCATCAACTGAGAAATCCAATATC   300

Query    301  ATTAGAGGCTGGATTTTCGGAACGACCCTGGATTCTAAAACGCAATCCTTGCTGATTGTT   360
              ATTAGAGGCTGGATTTTCGGAACGACCCTGGATTCTAAAACGCAATCCTTGCTGATTGTT
Sbjct    301  ATTAGAGGCTGGATTTTCGGAACGACCCTGGATTCTAAAACGCAATCCTTGCTGATTGTT   360

Query    361  AATAATGCAACAAATGTGGTCATTAAAGTCTGTGAATTCCAATTTTGCAATGATCCATTT   420
              AATAATGCAACAAATGTGGTCATTAAAGTCTGTGAATTCCAATTTTGCAATGATCCATTT
Sbjct    361  AATAATGCAACAAATGTGGTCATTAAAGTCTGTGAATTCCAATTTTGCAATGATCCATTT   420

Query    421  CTCGGCGTCTATTACCACAAGAATAACAAATCTTGGATGGAGTCAGAGTTCAGGGTTTAT   480
              CTCGGCGTCTATTACCACAAGAATAACAAATCTTGGATGGAGTCAGAGTTCAGGGTTTAT
Sbjct    421  CTCGGCGTCTATTACCACAAGAATAACAAATCTTGGATGGAGTCAGAGTTCAGGGTTTAT   480

Query    481  AGTTCCGCAAATAATTGTACTTTTGAATACGTTTCCCAACCATTCTTAATGGACTTGGAG   540
              AGTTCCGCAAATAATTGTACTTTTGAATACGTTTCCCAACCATTCTTAATGGACTTGGAG
Sbjct    481  AGTTCCGCAAATAATTGTACTTTTGAATACGTTTCCCAACCATTCTTAATGGACTTGGAG   540

Query    541  GGAAAACAGGGAAATTTTAAGAATCTAAGAGAATTCGTCTTTAAGAATATTGATGGATAT   600
              GGAAAACAGGGAAATTTTAAGAATCTAAGAGAATTCGTCTTTAAGAATATTGATGGATAT
Sbjct    541  GGAAAACAGGGAAATTTTAAGAATCTAAGAGAATTCGTCTTTAAGAATATTGATGGATAT   600

Query    601  TTCAAGATCTATTCAAAACATACACCTATAAACCTAGTTAGAGATCTCCCGCAAGGGTTT   660
              TTCAAGATCTATTCAAAACATACACCTATAAACCTAGTTAGAGATCTCCCGCAAGGGTTT
Sbjct    601  TTCAAGATCTATTCAAAACATACACCTATAAACCTAGTTAGAGATCTCCCGCAAGGGTTT   660

Query    661  TCAGCCCTAGAGCCACTAGTTGACCTGCCAATTGGGATCAACATTACTAGATTCCAGACC   720
              TCAGCCCTAGAGCCACTAGTTGACCTGCCAATTGGGATCAACATTACTAGATTCCAGACC
Sbjct    661  TCAGCCCTAGAGCCACTAGTTGACCTGCCAATTGGGATCAACATTACTAGATTCCAGACC   720

Query    721  CTACTCGCTCTGCATCGGTCATATTTGACACCAGGAGATTCATCGTCAGGATGGACCGCT   780
              CTACTCGCTCTGCATCGGTCATATTTGACACCAGGAGATTCATCGTCAGGATGGACCGCT
Sbjct    721  CTACTCGCTCTGCATCGGTCATATTTGACACCAGGAGATTCATCGTCAGGATGGACCGCT   780

Query    781  GGAGCAGCTGCTTACTATGTTGGGTATCTGCAACCTAGAACATTTCTCCTAAAGTATAAT   840
              GGAGCAGCTGCTTACTATGTTGGGTATCTGCAACCTAGAACATTTCTCCTAAAGTATAAT
Sbjct    781  GGAGCAGCTGCTTACTATGTTGGGTATCTGCAACCTAGAACATTTCTCCTAAAGTATAAT   840

Query    841  GAAAACGGGACTATTACAGACGCAGTCGATTGCGCACTGGATCCACTCTCAGAGACAAAG   900
              GAAAACGGGACTATTACAGACGCAGTCGATTGCGCACTGGATCCACTCTCAGAGACAAAG
Sbjct    841  GAAAACGGGACTATTACAGACGCAGTCGATTGCGCACTGGATCCACTCTCAGAGACAAAG   900

Query    901  TGCACTCTAAAATCATTCACTGTCGAGAAAGGAATCTATCAAACATCAAATTTCAGGGTC   960
              TGCACTCTAAAATCATTCACTGTCGAGAAAGGAATCTATCAAACATCAAATTTCAGGGTC
Sbjct    901  TGCACTCTAAAATCATTCACTGTCGAGAAAGGAATCTATCAAACATCAAATTTCAGGGTC   960

Query    961  CAGCCAACTGAGAGTATTGTCCGGTTCCCTAACATAACTAACTTGTGCCCCTTCGGAGAG  1020
              CAGCCAACTGAGAGTATTGTCCGGTTCCCTAACATAACTAACTTGTGCCCCTTCGGAGAG
Sbjct    961  CAGCCAACTGAGAGTATTGTCCGGTTCCCTAACATAACTAACTTGTGCCCCTTCGGAGAG  1020

Query    1021 GTTTTCAATGCTACTCGGTTCGCCAGCGTCTACGCATGGAACAGAAAGAGGATTTCAAAC  1080
              GTTTTCAATGCTACTCGGTTCGCCAGCGTCTACGCATGGAACAGAAAGAGGATTTCAAAC
Sbjct    1021 GTTTTCAATGCTACTCGGTTCGCCAGCGTCTACGCATGGAACAGAAAGAGGATTTCAAAC  1080

Query    1081 TGTGTCGCAGATTATAGCGTCCTCTATAATTCAGCATCATTCAGTACATTTAAATGCTAT  1140
```

*Fig. 20*

```
                TGTGTCGCAGATTATAGCGTCCTCTATAATTCAGCATCATTCAGTACATTTAAATGCTAT
Sbjct   1081    TGTGTCGCAGATTATAGCGTCCTCTATAATTCAGCATCATTCAGTACATTTAAATGCTAT   1140

Query   1141    GGTGTCAGCCCCACCAAACTTAATGACTTATGTTTTACCAATGTATATGCAGATTCCTTT   1200
                GGTGTCAGCCCCACCAAACTTAATGACTTATGTTTTACCAATGTATATGCAGATTCCTTT
Sbjct   1141    GGTGTCAGCCCCACCAAACTTAATGACTTATGTTTTACCAATGTATATGCAGATTCCTTT   1200

Query   1201    GTAATCAGAGGTGACGAAGTGAGGCAAATCGCACCTGGACAGACCGGAAAGATTGCTGAT   1260
                GTAATCAGAGGTGACGAAGTGAGGCAAATCGCACCTGGACAGACCGGAAAGATTGCTGAT
Sbjct   1201    GTAATCAGAGGTGACGAAGTGAGGCAAATCGCACCTGGACAGACCGGAAAGATTGCTGAT   1260

Query   1261    TATAATTATAAACTCCCTGATGATTTTACCGGATGTGTTATTGCTTGGAACAGCAATAAC   1320
                TATAATTATAAACTCCCTGATGATTTTACCGGATGTGTTATTGCTTGGAACAGCAATAAC
Sbjct   1261    TATAATTATAAACTCCCTGATGATTTTACCGGATGTGTTATTGCTTGGAACAGCAATAAC   1320

Query   1321    CTCGATAGTAAGGTCGGAGGAAACTATAACTATTTGTACAGACTGTTTAGAAAGTCGAAT   1380
                CTCGATAGTAAGGTCGGAGGAAACTATAACTATTTGTACAGACTGTTTAGAAAGTCGAAT
Sbjct   1321    CTCGATAGTAAGGTCGGAGGAAACTATAACTATTTGTACAGACTGTTTAGAAAGTCGAAT   1380

Query   1381    TTGAAACCTTTTGAAAGAGACATATCCACCGAGATTTACCAGGCGGGCAGCACACCGTGT   1440
                TTGAAACCTTTTGAAAGAGACATATCCACCGAGATTTACCAGGCGGGCAGCACACCGTGT
Sbjct   1381    TTGAAACCTTTTGAAAGAGACATATCCACCGAGATTTACCAGGCGGGCAGCACACCGTGT   1440

Query   1441    AATGGTGTAGAAGGATTCAATTGTTACTTTCCCCTGCAATCATATGGGTTTCAACCAACC   1500
                AATGGTGTAGAAGGATTCAATTGTTACTTTCCCCTGCAATCATATGGGTTTCAACCAACC
Sbjct   1441    AATGGTGTAGAAGGATTCAATTGTTACTTTCCCCTGCAATCATATGGGTTTCAACCAACC   1500

Query   1501    AATGGAGTCGGATATCAACCATATCGTGTCGTCGTCCTTTCCTTCGAGCTGCTTCATGCA   1560
                AATGGAGTCGGATATCAACCATATCGTGTCGTCGTCCTTTCCTTCGAGCTGCTTCATGCA
Sbjct   1501    AATGGAGTCGGATATCAACCATATCGTGTCGTCGTCCTTTCCTTCGAGCTGCTTCATGCA   1560

Query   1561    CCAGCTACAGTCTGCGGACCTAAGAAGAGCACTAATCTTGTCAAGAACAAATGTGTGAAC   1620
                CCAGCTACAGTCTGCGGACCTAAGAAGAGCACTAATCTTGTCAAGAACAAATGTGTGAAC
Sbjct   1561    CCAGCTACAGTCTGCGGACCTAAGAAGAGCACTAATCTTGTCAAGAACAAATGTGTGAAC   1620

Query   1621    TTTAATTTTAATGGATTAACAGGAACCGGAGTTTTGACCGAGAGTAATAAGAAGTTCTTG   1680
                TTTAATTTTAATGGATTAACAGGAACCGGAGTTTTGACCGAGAGTAATAAGAAGTTCTTG
Sbjct   1621    TTTAATTTTAATGGATTAACAGGAACCGGAGTTTTGACCGAGAGTAATAAGAAGTTCTTG   1680

Query   1681    CCGTTCCAGCAATTTGGACGAGACATTGCTGACACCACAGATGCGGTTCGTGACCCGCAA   1740
                CCGTTCCAGCAATTTGGACGAGACATTGCTGACACCACAGATGCGGTTCGTGACCCGCAA
Sbjct   1681    CCGTTCCAGCAATTTGGACGAGACATTGCTGACACCACAGATGCGGTTCGTGACCCGCAA   1740

Query   1741    ACTTTAGAGATCCTAGACATCACCCCATGTTCATTCGGTGGAGTTTCCGTTATTACTCCT   1800
                ACTTTAGAGATCCTAGACATCACCCCATGTTCATTCGGTGGAGTTTCCGTTATTACTCCT
Sbjct   1741    ACTTTAGAGATCCTAGACATCACCCCATGTTCATTCGGTGGAGTTTCCGTTATTACTCCT   1800

Query   1801    GGAACGAATACAAGCAATCAAGTTGCCGTTCTCTATCAAGATGTTAATTGTACAGAAGTG   1860
                GGAACGAATACAAGCAATCAAGTTGCCGTTCTCTATCAAGATGTTAATTGTACAGAAGTG
Sbjct   1801    GGAACGAATACAAGCAATCAAGTTGCCGTTCTCTATCAAGATGTTAATTGTACAGAAGTG   1860

Query   1861    CCTGTGGCCATTCATGCAGATCAACTAACACCAACTTGGAGAGTTTACAGCACTGGGTCC   1920
                CCTGTGGCCATTCATGCAGATCAACTAACACCAACTTGGAGAGTTTACAGCACTGGGTCC
Sbjct   1861    CCTGTGGCCATTCATGCAGATCAACTAACACCAACTTGGAGAGTTTACAGCACTGGGTCC   1920

Query   1921    AATGTCTTCCAAACGCGCGCCGGCTGCCTCATTGGTGCAGAACATGTGAATAACTCATAC   1980
                AATGTCTTCCAAACGCGCGCCGGCTGCCTCATTGGTGCAGAACATGTGAATAACTCATAC
Sbjct   1921    AATGTCTTCCAAACGCGCGCCGGCTGCCTCATTGGTGCAGAACATGTGAATAACTCATAC   1980

Query   1981    GAATGTGACATTCCAATCGGTGCCGGCATATGCGCCTCTTACCAGACTCAGACTAATTCG   2040
                GAATGTGACATTCCAATCGGTGCCGGCATATGCGCCTCTTACCAGACTCAGACTAATTCG
Sbjct   1981    GAATGTGACATTCCAATCGGTGCCGGCATATGCGCCTCTTACCAGACTCAGACTAATTCG   2040

Query   2041    CCAAGAAGAGCCAGGTCTGTCGCAAGTCAGTCAATTATTGCATACACAATGTCGTTAGGA   2100
                CCAAGA GAGCCAGGTCTGTCGCAAGTCAGTCAATTATTGCATACACAATGTCGTTAGGA
Sbjct   2041    CCAAGAGGAGCCAGGTCTGTCGCAAGTCAGTCAATTATTGCATACACAATGTCGTTAGGA   2100

Query   2101    GCAGAGAATAGTGTAGCATACTCAAACAATTCTATAGCAATACCTACCAACTTCACTATA   2160
                GCAGAGAATAGTGTAGCATACTCAAACAATTCTATAGCAATACCTACCAACTTCACTATA
Sbjct   2101    GCAGAGAATAGTGTAGCATACTCAAACAATTCTATAGCAATACCTACCAACTTCACTATA   2160

Query   2161    TCAGTAACTACAGAAATATTGCCAGTATCCATGACTAAAACAAGTGTGGATTGCACCATG   2220
                TCAGTAACTACAGAAATATTGCCAGTATCCATGACTAAAACAAGTGTGGATTGCACCATG
Sbjct   2161    TCAGTAACTACAGAAATATTGCCAGTATCCATGACTAAAACAAGTGTGGATTGCACCATG   2220

Query   2221    TACATCTGTGGAGATTCCACAGAATGCAGCAATCTTCTCTTGCAATACGGATCATTCTGC   2280
                TACATCTGTGGAGATTCCACAGAATGCAGCAATCTTCTCTTGCAATACGGATCATTCTGC
Sbjct   2221    TACATCTGTGGAGATTCCACAGAATGCAGCAATCTTCTCTTGCAATACGGATCATTCTGC   2280

Query   2281    ACACAACTGAATAGGGCACTGACTGGAATTGCAGTCGAGCAGGATAAGAACACACAGGAG   2340
                ACACAACTGAATAGGGCACTGACTGGAATTGCAGTCGAGCAGGATAAGAACACACAGGAG
Sbjct   2281    ACACAACTGAATAGGGCACTGACTGGAATTGCAGTCGAGCAGGATAAGAACACACAGGAG   2340

Query   2341    GTGTTTGCCCAAGTCAAACAAATATACAAAACACCACCCATCAAGGATTTTGGAGGATTT   2400
                GTGTTTGCCCAAGTCAAACAAATATACAAAACACCACCCATCAAGGATTTTGGAGGATTT
Sbjct   2341    GTGTTTGCCCAAGTCAAACAAATATACAAAACACCACCCATCAAGGATTTTGGAGGATTT   2400

Query   2401    AATTTCTCACAAATACTCCCCGACCCATCCAAGCCCTCCAAAAGGAGTTTCATTGAGGAC   2460
```

*Fig. 20 (cont.)*

```
                AATTTCTCACAAATACTCCCCGACCCATCCAAGCCCT CAAAAGGAGTTTCATTGAGGAC
Sbjct   2401    AATTTCTCACAAATACTCCCCGACCCATCCAAGCCCTTCAAAAGGAGTTTCATTGAGGAC  2460

Query   2461    CTCTTGTTTAATAAGGTTACCTTGGCAGATGCCGGGTTTATTAAGCAGTACGGCGACTGT  2520
                CTCTTGTTTAATAAGGTTACCTTGGCAGATGCCGGGTTTATTAAGCAGTACGGCGACTGT
Sbjct   2461    CTCTTGTTTAATAAGGTTACCTTGGCAGATGCCGGGTTTATTAAGCAGTACGGCGACTGT  2520

Query   2521    CTTGGAGACATAGCAGCCAGAGATCTAATTTGTGCCCAGAAATTCAATGGACTGACAGTC  2580
                CTTGGAGACATAGCAGCCAGAGATCTAATTTGTGCCCAGAAATTCAATGGACTGACAGTC
Sbjct   2521    CTTGGAGACATAGCAGCCAGAGATCTAATTTGTGCCCAGAAATTCAATGGACTGACAGTC  2580

Query   2581    CTGCCTCCCTTATTAACTGATGAGATGATAGCTCAGTATACATCAGCATTGTTGGCTGGT  2640
                CTGCCTCCCTTATTAACTGATGAGATGATAGCTCAGTATACATCAGCATTGTTGGCTGGT
Sbjct   2581    CTGCCTCCCTTATTAACTGATGAGATGATAGCTCAGTATACATCAGCATTGTTGGCTGGT  2640

Query   2641    ACAATTACATCTGGATGGACATTTGGTGCCGGAGCGGCATTACAAATCCCTTTTGCAATG  2700
                ACAATTACATCTGGATGGACATTTGGTGCCGGAGCGGCATTACAAATCCCTTTTGCAATG
Sbjct   2641    ACAATTACATCTGGATGGACATTTGGTGCCGGAGCGGCATTACAAATCCCTTTTGCAATG  2700

Query   2701    CAAATGGCCTATAGATTTAATGGAATCGGAGTAACTCAAAATGTTTTATATGAGAATCAG  2760
                CAAATGGCCTATAGATTTAATGGAATCGGAGTAACTCAAAATGTTTTATATGAGAATCAG
Sbjct   2701    CAAATGGCCTATAGATTTAATGGAATCGGAGTAACTCAAAATGTTTTATATGAGAATCAG  2760

Query   2761    AAATTAATTGCAAATCAATTCAATTCAGCTATAGGAAAGATTCAGGATTCACTCAGTAGT  2820
                AAATTAATTGCAAATCAATTCAATTCAGCTATAGGAAAGATTCAGGATTCACTCAGTAGT
Sbjct   2761    AAATTAATTGCAAATCAATTCAATTCAGCTATAGGAAAGATTCAGGATTCACTCAGTAGT  2820

Query   2821    ACAGCAAGCGCTCTAGGCAAATTACAAGACGTCGTCAATCAGAATGCACAGGCATTAAAT  2880
                ACAGCAAGCGCTCTAGGCAAATTACAAGACGTCGTCAATCAGAATGCACAGGCATTAAAT
Sbjct   2821    ACAGCAAGCGCTCTAGGCAAATTACAAGACGTCGTCAATCAGAATGCACAGGCATTAAAT  2880

Query   2881    ACACTGGTGAAGCAATTGAGTTCCAATTTCGGAGCAATTTCATCTGTTCTAAATGATATA  2940
                ACACTGGTGAAGCAATTGAGTTCCAATTTCGGAGCAATTTCATCTGTTCTAAATGATATA
Sbjct   2881    ACACTGGTGAAGCAATTGAGTTCCAATTTCGGAGCAATTTCATCTGTTCTAAATGATATA  2940

Query   2941    TTGTCAAGACTGGATAAAGTAGAAGCCGAGGTCCAAATCGATAGGCTGATCACAGGAAGA  3000
                TTGTCAAGACTGGATAAAGTAGAAGCCGAGGTCCAAATCGATAGGCTGATCACAGGAAGA
Sbjct   2941    TTGTCAAGACTGGATAAAGTAGAAGCCGAGGTCCAAATCGATAGGCTGATCACAGGAAGA  3000

Query   3001    CTTCAATCACTACAGACATACGTCACCCAACAACTCATCAGAGCAGCAGAAATTAGAGCC  3060
                CTTCAATCACTACAGACATACGTCACCCAACAACTCATCAGAGCAGCAGAAATTAGAGCC
Sbjct   3001    CTTCAATCACTACAGACATACGTCACCCAACAACTCATCAGAGCAGCAGAAATTAGAGCC  3060

Query   3061    TCTGCTAATCTAGCCGCAACAAAGATGTCAGAGTGCGTATTGGGACAATCTAAGAGGGTC  3120
                TCTGCTAATCTAGCCGCAACAAAGATGTCAGAGTGCGTATTGGGACAATCTAAGAGGGTC
Sbjct   3061    TCTGCTAATCTAGCCGCAACAAAGATGTCAGAGTGCGTATTGGGACAATCTAAGAGGGTC  3120

Query   3121    GACTTTTGTGGAAAGGGGTATCACTTGATGTCCTTTCCTCAATCTGCACCACACGGAGTT  3180
                GACTTTTGTGGAAAGGGGTATCACTTGATGTCCTTTCCTCAATCTGCACCACACGGAGTT
Sbjct   3121    GACTTTTGTGGAAAGGGGTATCACTTGATGTCCTTTCCTCAATCTGCACCACACGGAGTT  3180

Query   3181    GTCTTCTTACATGTAACATATGTGCCCGCTCAAGAAAAGAATTTCACTACAGCACCTGCA  3240
                GTCTTCTTACATGTAACATATGTGCCCGCTCAAGAAAAGAATTTCACTACAGCACCTGCA
Sbjct   3181    GTCTTCTTACATGTAACATATGTGCCCGCTCAAGAAAAGAATTTCACTACAGCACCTGCA  3240

Query   3241    ATATGTCATGACGGAAAAGCACATTTTCCTCGGGAGGGAGTTTTCGTTTCTAATGGAACC  3300
                ATATGTCATGACGGAAAAGCACATTTTCCTCGGGAGGGAGTTTTCGTTTCTAATGGAACC
Sbjct   3241    ATATGTCATGACGGAAAAGCACATTTTCCTCGGGAGGGAGTTTTCGTTTCTAATGGAACC  3300

Query   3301    CATTGGTTCGTGACCCAAAGGAACTTTTACGAGCCTCAAATAATTACAACTGATAATACA  3360
                CATTGGTTCGTGACCCAAAGGAACTTTTACGAGCCTCAAATAATTACAACTGATAATACA
Sbjct   3301    CATTGGTTCGTGACCCAAAGGAACTTTTACGAGCCTCAAATAATTACAACTGATAATACA  3360

Query   3361    TTCGTTTCTGGAAATTGCGACGTAGTTATAGGTATTGTAAATAATACTGTTTATGACCCT  3420
                TTCGTTTCTGGAAATTGCGACGTAGTTATAGGTATTGTAAATAATACTGTTTATGACCCT
Sbjct   3361    TTCGTTTCTGGAAATTGCGACGTAGTTATAGGTATTGTAAATAATACTGTTTATGACCCT  3420

Query   3421    TTACAACCTGAACTCGATTCCTTCAAGGAAGAACTCGACAAATATTTTAAGAATCACACC  3480
                TTACAACCTGAACTCGATTCCTTCAAGGAAGAACTCGACAAATATTTTAAGAATCACACC
Sbjct   3421    TTACAACCTGAACTCGATTCCTTCAAGGAAGAACTCGACAAATATTTTAAGAATCACACC  3480

Query   3481    TCACCGGACGTTGACTTAGGAGACATTTCCGGGATTAACGCTAGTGTAGTCAATATCCAA  3540
                TCACCGGACGTTGACTTAGGAGACATTTCCGGGATTAACGCTAGTGTAGTCAATATCCAA
Sbjct   3481    TCACCGGACGTTGACTTAGGAGACATTTCCGGGATTAACGCTAGTGTAGTCAATATCCAA  3540

Query   3541    AAGGAGATAGATAGACTGAATGAGGTAGCAAAGAATCTTAATGAATCTTTGATCGACCTT  3600
                AAGGAGATAGATAGACTGAATGAGGTAGCAAAGAATCTTAATGAATCTTTGATCGACCTT
Sbjct   3541    AAGGAGATAGATAGACTGAATGAGGTAGCAAAGAATCTTAATGAATCTTTGATCGACCTT  3600

Query   3601    CAGGAGCTGGGGAAGTACGAACAATACATAAAATGGCCATGGTACATTTGGCTCGGGTTT  3660
                CAGGAGCTGGGGAAGTACGAACAATACATAAAATGGCCATGGTACATTTGGCTCGGGTTT
Sbjct   3601    CAGGAGCTGGGGAAGTACGAACAATACATAAAATGGCCATGGTACATTTGGCTCGGGTTT  3660

Query   3661    ATTGCTGGACTAATTGCAATAGTCATGGTCACTATCATGCTGTGTTGTATGACATCGTGC  3720
                ATTGCTGGACTAATTGCAATAGTCATGGTCACTATCATGCTGTGTTGTATGACATCGTGC
Sbjct   3661    ATTGCTGGACTAATTGCAATAGTCATGGTCACTATCATGCTGTGTTGTATGACATCGTGC  3720

Query   3721    TGCTCATGCCTCAAGGGATGTTGTAGCTGTGGATCTTGTTGCAAGTTCGATGAGGATGAT  3780
```

*Fig. 20 (cont.)*

```
                TGCTCATGCCTCAAGGGATGTTGTAGCTGT GATCTTGTTGCAAGTTCGATGAGGATGAT
Sbjct   3721    TGCTCATGCCTCAAGGGATGTTGTAGCTGTTGATCTTGTTGCAAGTTCGATGAGGATGAT   3780

Query   3781    TCAGAACCAGTTTTAAAAGGAGTAAAGTTGCATTACACATAA   3822
                TCAGAACCAGTTTTAAAAGGAGTAAAGTTGCATTACACATAA
Sbjct   3781    TCAGAACCAGTTTTAAAAGGAGTAAAGTTGCATTACACATAA   3822

Lambda            K           H           a           alpha
  0.321           0.125       0.462       0.792       4.96

Gapped
Lambda            K           H           a           alpha       sigma
  0.267           0.0410      0.140       1.90        42.6        43.6

Effective search space used: 14122564

Matrix: BLOSUM62

Gap Penalties: Existence: 11,
Extension: 1 Neighboring words
threshold: 11

Window for multiple hits: 40
```

Fig. 20 (cont.)

```
VSV-N   VSV-P   XhoI  SARS-CoV2-S              G1251*         VSV-L
          VSV-M       protein-optimized  H655Y  Nhel
```

MB2 whole genome sequence
13440 bp

*Fig. 21A*

VSV-N amino acid sequence of MB2 (SEQ ID NO: 155)

MSVTVKRIIDNTVVVPKLPANEDPVEYPADYFRKSKEIPLYINTTKSLSDLRGYVYQG
LKSGNVSIIHVNSYLYGALKDIRGKLDKDWSSFGINIGKAGDTIGIFDLVSLKALDGV
LPDGVSDASRTSADDKWLPLYLLGLYRVGRTQMPEYRKKLMDGLTNQCKMINEQF
EPLVPEGRDIFDVWGNDSNYTKIVAAVDMFFHMFKKHECASFRYGTIVSRFKDCAA
LATFGHLCKITGMSTEDVTTWILNREVADEMVQMMLPGQEIDKADSYMPYLIDFGL
SSKSPYSSVKNPAFHFWGQLTALLLRSTRARNARQPDDIEYTSLTTAGLLYAYAVGS
SADLAQQFCVGDNKYTPDDSTGGLTTNAPPQGRDVVEWLGWFEDQNRKPTPDMM
QYAKRAVMSLQGLREKTIGKYAKSEFDK*

*Fig. 21B*

VSV-P amino acid sequence of MB2 (SEQ ID NO: 156)

MDNLTKVREYLKSYSRLDQAVGEIDEIEAQRAEKSNYELFQEDGVEEHTKPSYFQAA
DDSDTESEPEIEDNQGLYAPDPEAEQVEGFIQGPLDDYADEEVDVVFTSDWKQPELE
SDEHGKTLRLTSPEGLSGEQKSQWLSTIKAVVQSAKYWNLAECTFEASGEGVIMKER
QITPDVYKVTPVMNTHPSQSEAVSDVWSLSKTSMTFQPKKASLQPLTISLDELFSSRG
EFISVGGDGRMSHKEAILLGLRYKKLYNQARVKYSL*

*Fig. 21C*

VSV-M amino acid sequence of MB2 (SEQ ID NO: 157)

MSSLKKILGLKGKGKKSKKLGIAPPPYEEDTSMEYAPSAPIDKSYFGVDEMDTYDPN
QLRYEKFFFTVKMTVRSNRPFRTYSDVAAAVSHWDHMYIGMAGKRPFYKILAFLGS
SNLKATPAVLADQGQPEYHAHCEGRAYLPHRMGKTPPMLNVPEHFRRPFNIGLYKG
TIELTMTIYDDESLEAAPMIWDHFNSSKFSDFREKALMFGLIVEKKASGAWVLDSIGH
FK*

*Fig. 21D*

SARS-CoV-2 S protein sequence (with H665Y and G1251* mutations)
of MB2 (SEQ ID NO: 158)

MFVFLVLLPLVSSQCVNLTTRTQLPPAYTNSFTRGVYYPDKVFRSSVLHSTQDLFLPF
FSNVTWFHAIHVSGTNGTKRFDNPVLPFNDGVYFASTEKSNIIRGWIFGTTLDSKTQS
LLIVNNATNVVIKVCEFQFCNDPFLGVYYHKNNKSWMESEFRVYSSANNCTFEYVS
QPFLMDLEGKQGNFKNLREFVFKNIDGYFKIYSKHTPINLVRDLPQGFSALEPLVDLP
IGINITRFQTLLALHRSYLTPGDSSSGWTAGAAAYYVGYLQPRTFLLKYNENGTITDA
VDCALDPLSETKCTLKSFTVEKGIYQTSNFRVQPTESIVRFPNITNLCPFGEVFNATRF
ASVYAWNRKRISNCVADYSVLYNSASFSTFKCYGVSPTKLNDLCFTNVYADSFVIRG
DEVRQIAPGQTGKIADYNYKLPDDFTGCVIAWNSNNLDSKVGGNYNYLYRLFRKSN
LKPFERDISTEIYQAGSTPCNGVEGFNCYFPLQSYGFQPTNGVGYQPYRVVVLSFELL
HAPATVCGPKKSTNLVKNKCVNFNFNGLTGTGVLTESNKKFLPFQQFGRDIADTTD
AVRDPQTLEILDITPCSFGGVSVITPGTNTSNQVAVLYQDVNCTEVPVAIHADQLTPT
WRVYSTGSNVFQTRAGCLIGAEYVNNSYECDIPIGAGICASYQTQTNSPRRARSVAS
QSIIAYTMSLGAENSVAYSNNSIAIPTNFTISVTTEILPVSMTKTSVDCTMYICGDSTEC
SNLLLQYGSFCTQLNRALTGIAVEQDKNTQEVFAQVKQIYKTPPIKDFGGFNFSQILP
DPSKPSKRSFIEDLLFNKVTLADAGFIKQYGDCLGDIAARDLICAQKFNGLTVLPPLLT
DEMIAQYTSALLAGTITSGWTFGAGAALQIPFAMQMAYRFNGIGVTQNVLYENQKLI
ANQFNSAIGKIQDSLSSTASALGKLQDVVNQNAQALNTLVKQLSSNFGAISSVLNDIL
SRLDKVEAEVQIDRLITGRLQSLQTYVTQQLIRAAEIRASANLAATKMSECVLGQSKR
VDFCGKGYHLMSFPQSAPHGVVFLHVTYVPAQEKNFTTAPAICHDGKAHFPREGVF
VSNGTHWFVTQRNFYEPQIITTDNTFVSGNCDVVIGIVNNTVYDPLQPELDSFKEELD
KYFKNHTSPDVDLGDISGINASVVNIQKEIDRLNEVAKNLNESLIDLQELGKYEQYIK
WPWYIWLGFIAGLIAIVMVTIMLCCMTSCCSCLKGCCSC*

*Fig. 21E*

VSV-L amino acid sequence (with an I1343I silent mutation)
of MB2 (SEQ ID NO: 152)

```
MEVHDFETDEFNDFNEDDYATREFLNPDERMTYLNHADYNLNSPLISDDIDNLIRKF
NSLPIPSMWDSKNWDGVLEMLTSCQANPIPTSQMHKWMGSWLMSDNHDASQGYSF
LHEVDKEAEITFDVVETFIRGWGNKPIEYIKKERWTDSFKILAYLCQKFLDLHKLTLIL
NAVSEVELLNLARTFKGKVRRSSHGTNICRIRVPSLGPTFISEGWAYFKKLDILMDRN
FLLMVKDVIIGRMQTVLSMVCRIDNLFSEQDIFSLLNIYRIGDKIVERQGNFSYDLIKM
VEPICNLKLMKLARESRPLVPQFPHFENHIKTSVDEGAKIDRGIRFLHDQIMSVKTVD
LTLVIYGSFRHWGHPFIDYYTGLEKLHSQVTMKKDIDVSYAKALASDLARIVLFQQF
NDHKKWFVNGDLLPHDHPFKSHVKENTWPTAAQVQDFGDKWHELPLIKCFEIPDLL
DPSIIYSDKSHSMNRSEVLKHVRMNPNTPIPSKKVLQTMLDTKATNWKEFLKEIDEK
GLDDDDLIIGLKGKERELKLAGRFFSLMSWKLREYFVITEYLIKTHFVPMFKGLTMA
DDLTAVIKKMLDSSSGQGLKSYEAICIANHIDYEKWNNHQRKLSNGPVFRVMGQFL
GYPSLIERTHEFFEKSLIYYNGRPDLMRVHNNTLINSTSQRVCWQGQEGGLEGLRQK
GWSILNLLVIQREAKIRNTAVKVLAQGDNQVICTQYKTKKSRNVVELQGALNQMVS
NNEKIMTAIKIGTGKLGLLINDDETMQSADYLNYGKIPIFRGVIRGLETKRWSRVTCV
TNDQIPTCANIMSSVSTNALTVAHFAENPINAMIQYNYFGTFARLLLMMHDPALRQS
LYEVQDKIPGLHSSTFKYAMLYLDPSIGGVSGMSLSRFLIRAFPDPVTESLSFWRFIHV
HARSEHLKEMSAVFGNPEIAKFRITHIDKLVEDPTSLNIAMGMSPANLLKTEVKKCLI
ESRQTIRNQVIKDATIYLYHEEDRLRSFLWSINPLFPRFLSEFKSGTFLGVADGLISLFQ
NSRTIRNSFKKKYHRELDDLIVRSEVSSLTHLGKLHLRRGSCKMWTCSATHADTLRY
KSWGRTVIGTTVPHPLEMLGPQHRKETPCAPCNTSGFNYVSVHCPDGIHDVFSSRGP
LPAYLGSKTSESTSILQPWERESKVPLIKRATRLRDAISWFVEPDSKLAMTILSNIHSLT
GEEWTKRQHGFKRTGSALHRFSTSRMSHGGFASQSTAALTRLMATTDTMRDLGDQ
NFDFLFQATLLYAQITTTVARDGWITSCTDHYHIACKSCLRPIEEITLDSSMDYTPPDV
SHVLKTWRNGEGSWGQEIKQIYPLEGNWKNLAPAEQSYQVGRCIGFLYGDLAYRKS
THAEDSSLFPLSIQGRIRGRGFLKGLLDGLMRASCCQVIHRRSLAHLKRPANAVYGG
LIYLIDKLSVSPPFLSLTRSGPIRDELETIPHKIPTSYPTSNRDMGVIVRNYFKYQCRLIE
KGKYRSHYSQLWLFSDVLSIDFIGPFSISTTLLQILYKPFLSGKDKNELRELANLSSLLR
SGEGWEDIHVKFFTKDILLCPEEIRHACKFGIAKDNNKDMSYPPWGRESRGTITTIPV
YYTTTPYPKMLEMPPRIQNPLLSGIRLGQLPTGAHYKIRSILHGMGIHYRDFLSCGDG
SGGMTAALLRENVHSRGIFNSLLELSGSVMRGASPEPPSALETLGGDKSRCVNGETC
WEYPSDLCDPRTWDYFLRLKAGLGLQIDLIVMDMEVRDSSTSLKIETNVRNYVHRIL
DEQGVLIYKTYGTYICESEKNAVTILGPMFKTVDLVQTEFSSSQTSEVYMVCKGLKK
LIDEPNPDWSSINESWKNLYAFQSSEQEFARAKKVSTYFTLTGIPSQFIPDPFVNIETM
LQIFGVPTGVSHAAALKSSDRPADLLTISLFYMAIISYYNINHIRVGPIPPNPPSDGIAQ
NVGIAITGISFWLSLMEKDIPLYQQCLAVIQQSFPIRWEAVSVKGGYKQKWSTRGDG
LPKDTRISDSLAPIGNWIRSLELVRNQVRLNPFNEILFNQLCRTVDNHLKWSNLRRNT
GMIEWINRRISKEDRSILMLKSDLHEENSWRD*
```

Fig. 21F

Nucleotide sequence of VSVΔG-SARS-CoV-2 clone MB2 (SEQ ID NO: 154)

```
   1  ACGAAGACAA ACAAACCATT ATTATCATTA AAAGGCTCAG GAGAAACTTT
  51  AACAGTAATC AAAATGTCTG TTACAGTCAA GAGAATCATT GACAACACAG
 101  TCGTAGTTCC AAAACTTCCT GCAAATGAGG ATCCAGTGGA ATACCCGGCA
 151  GATTACTTCA GAAAATCAAA GGAGATTCCT CTTTACATCA ATACTACAAA
 201  AAGTTTGTCA GATCTAAGAG GATATGTCTA CCAAGGCCTC AAATCCGGAA
 251  ATGTATCAAT CATACATGTC AACAGCTACT TGTATGGAGC ATTAAAGGAC
 301  ATCCGGGGTA AGTTGGATAA AGATTGGTCA AGTTTCGGAA TAAACATCGG
 351  GAAAGCAGGG GATACAATCG AATATTTGA CCTTGTATCC TTGAAAGCCC
 401  TGGACGGCGT ACTTCCAGAT GGAGTATCGG ATGCTTCCAG AACCAGCGCA
 451  GATGACAAAT GGTTGCCTTT GTATCTACTT GGCTTATACA GAGTGGGCAG
 501  AACACAAATG CCTGAATACA GAAAAAAGCT CATGGATGGG CTGACAAATC
 551  AATGCAAAAT GATCAATGAA CAGTTTGAAC CTCTTGTGCC AGAAGGTCGT
 601  GACATTTTTG ATGTGTGGGG AAATGACAGT AATTACACAA AAATTGTCGC
 651  TGCAGTGGAC ATGTTCTTCC ACATGTTCAA AAAACATGAA TGTGCCTCGT
 701  TCAGATACGG AACTATTGTT TCCAGATTCA AGATTGTGC TGCATTGGCA
 751  ACATTTGGAC ACCTCTGCAA AATAACCGGA ATGTCTACAG AAGATGTAAC
 801  GACCTGGATC TTGAACCGAG AAGTTGCAGA TGAAATGGTC AAATGATGC
 851  TTCCAGGCCA AGAAATTGAC AAGGCCGATT CATACATGCC TTATTTGATC
 901  GACTTTGGAT TGTCTTCTAA GTCTCCATAT TCTTCCGTCA AAAACCCTGC
 951  CTTCCACTTC TGGGGGCAAT TGACAGCTCT TCTGCTCAGA TCCACCAGAG
1001  CAAGGAATGC CCGACAGCCT GATGACATTG AGTATACATC TCTTACTACA
1051  GCAGGTTTGT TGTACGCTTA TGCAGTAGGA TCCTCTGCCG ACTTGGCACA
1101  ACAGTTTTGT GTTGGAGATA ACAAATACAC TCCAGATGAT AGTACCGGAG
1151  GATTGACGAC TAATGCACCG CCACAAGGCA GAGATGTGGT CGAATGGCTC
1201  GGATGGTTTG AAGATCAAAA CAGAAAACCG ACTCCTGATA TGATGCAGTA
1251  TGCGAAAAGA GCAGTCATGT CACTGCAAGG CCTAAGAGAG AAGACAATTG
1301  GCAAGTATGC TAAGTCAGAA TTTGACAAAT GACCCTATAA TTCTCAGATC
1351  ACCTATTATA TATTATGCTA CATATGAAAA AAACTAACAG ATATCATGGA
1401  TAATCTCACA AAAGTTCGTG AGTATCTCAA GTCCTATTCT CGTCTGGATC
1451  AGGCGGTAGG AGAGATAGAT GAGATCGAAG CACAACGAGC TGAAAAGTCC
1501  AATTATGAGT TGTTCCAAGA GGATGGAGTG GAAGAGCATA CTAAGCCCTC
1551  TTATTTTCAG GCAGCAGATG ATTCTGACAC AGAATCTGAA CCAGAAATTG
1601  AAGACAATCA AGGCTTGTAT GCACCAGATC CAGAAGCTGA GCAAGTTGAA
1651  GGCTTTATAC AGGGGCCTTT AGATGACTAT GCAGATGAGG AAGTGGATGT
1701  TGTATTTACT TCGGACTGGA AACAGCCTGA GCTTGAATCT GACGAGCATG
1751  GAAAGACCTT ACGGTTGACA TCGCCAGAGG GTTAAGTGG AGAGCAGAAA
1801  TCCCAGTGGC TTTCGACGAT TAAAGCAGTC GTGCAAAGTG CCAAATACTG
1851  GAATCTGGCA GAGTGCACAT TTGAAGCATC GGGAGAAGGG GTCATTATGA
1901  AGGAGCGCCA GATAACTCCG GATGTATATA AGGTCACTCC AGTGATGAAC
1951  ACACATCCGT CCCAATCAGA AGCAGTATCA GATGTTTGGT CTCTCTCAAA
2001  GACATCCATG ACTTTCCAAC CCAAGAAAGC AAGTCTTCAG CCTCTCACCA
2051  TATCCTTGGA TGAATTGTTC TCATCTAGAG GAGAGTTCAT CTCTGTCGGA
2101  GGTGACGGAC GAATGTCTCA TAAAGAGGCC ATCCTGCTCG GCCTGAGATA
2151  CAAAAAGTTG TACAATCAGG CGAGAGTCAA ATATTCTCTG TAGACTATGA
2201  AAAAAAGTAA CAGATATCAC GATCTAAGTG TTATCCCAAT CCATTCATCA
2251  TGAGTTCCTT AAAGAAGATT CTCGGTCTGA GGGGAAAGG TAAGAAATCT
2301  AAGAAATTAG GATCGCACC ACCCCCTTAT GAAGAGGACA CTAGCATGGA
2351  GTATGCTCCG AGCGCTCCAA TTGACAAATC CTATTTTGGA GTTGACGAGA
2401  TGGACACCTA TGATCCGAAT CAATTAAGAT ATGAGAAATT CTTCTTTACA
2451  GTGAAAATGA CGGTTAGATC TAATCGTCCG TTCAGAACAT ACTCAGATGT
2501  GGCAGCCGCT GTATCCCATT GGGATCACAT GTACATCGGA ATGGCAGGGA
2551  AACGTCCCTT CTACAAAATC TTGGCTTTTT TGGGTTCTTC TAATCTAAAG
2601  GCCACTCCAG CGGTATTGGC AGATCAAGGT CAACCAGAGT ATCACGCTCA
```

*Fig. 21G*

```
2651 CTGCGAAGGC AGGGCTTATT TGCCACATAG GATGGGGAAG ACCCCTCCCA
2701 TGCTCAATGT ACCAGAGCAC TTCAGAAGAC CATTCAATAT AGGTCTTTAC
2751 AAGGGAACGA TTGAGCTCAC AATGACCATC TACGATGATG AGTCACTGGA
2801 AGCAGCTCCT ATGATCTGGG ATCATTTCAA TTCTTCCAAA TTTTCTGATT
2851 TCAGAGAGAA GGCCTTAATG TTTGGCCTGA TTGTCGAGAA AAAGGCATCT
2901 GGAGCGTGGG TCCTGGACTC TATCGGCCAC TTCAAATGAG CTAGTCTAAC
2951 TTCTAGCTTC TGAACAATCC CCGGTTTACT CAGTCTCCCC TAATTCCAGC
3001 CTCTCGAACA ACTAATATCC TGTCTTTTCT ATCCCTATGA AAAAACTAA
3051 CAGAGATCGA TCTGTTTACG CGCTAGTGGA TCCTACTCGA GAGGAGCCAC
3101 CATGTTCGTG TTCCTGGTGC TATTACCTCT GGTTTCGTCT CAATGCGTAA
3151 ACCTTACAAC TAGAACTCAG CTTCCTCCAG CATACACAAA TTCCTTCACT
3201 CGCGGAGTGT ATTATCCTGA TAAGGTCTTT CGATCATCAG TGTTGCATTC
3251 CACCCAGGAT TTGTTTCTCC CGTTCTTTTC AAATGTAACT TGGTTCCATG
3301 CTATACATGT TTCCGGAACC AATGGAACAA AGAGATTTGA TAACCCAGTG
3351 TTACCATTTA ACGACGGAGT TTATTTCGCA TCAACTGAGA AATCCAATAT
3401 CATTAGAGGC TGGATTTTCG GAACGACCCT GGATTCTAAA ACGCAATCCT
3451 TGCTGATTGT TAATAATGCA ACAAATGTGG TCATTAAAGT CTGTGAATTC
3501 CAATTTTGCA ATGATCCATT TCTCGGCGTC TATTACCACA AGAATAACAA
3551 ATCTTGGATG GAGTCAGAGT TCAGGGTTTA TAGTTCCGCA AATAATTGTA
3601 CTTTTGAATA CGTTTCCCAA CCATTCTTAA TGGACTTGGA GGGAAAACAG
3651 GGAAATTTTA AGAATCTAAG AGAATTCGTC TTTAAGAATA TTGATGGATA
3701 TTTCAAGATC TATTCAAAAC ATACACCTAT AAACCTAGTT AGAGATCTCC
3751 CGCAAGGGTT TTCAGCCCTA GAGCCACTAG TTGACCTGCC AATTGGGATC
3801 AACATTACTA GATTCCAGAC CCTACTCGCT CTGCATCGGT CATATTTGAC
3851 ACCAGGAGAT TCATCGTCAG GATGGACCGC TGGAGCAGCT GCTTACTATG
3901 TTGGGTATCT GCAACCTAGA ACATTCTCC TAAAGTATAA TGAAAACGGG
3951 ACTATTACAG ACGCAGTCGA TTGCGCACTG GATCCACTCT CAGAGACAAA
4001 GTGCACTCTA AAATCATTCA CTGTCGAGAA AGGAATCTAT CAAACATCAA
4051 ATTTCAGGGT CCAGCCAACT GAGAGTATTG TCCGGTTCCC TAACATAACT
4101 AACTTGTGCC CCTTCGGAGA GGTTTTCAAT GCTACTCGGT TCGCCAGCGT
4151 CTACGCATGG AACAGAAAGA GGATTTCAAA CTGTGTCGCA GATTATAGCG
4201 TCCTCTATAA TTCAGCATCA TTCAGTACAT TTAAATGCTA TGGTGTCAGC
4251 CCCACCAAAC TTAATGACTT ATGTTTTACC AATGTATATG CAGATTCCTT
4301 TGTAATCAGA GGTGACGAAG TGAGGCAAAT CGCACCTGGA CAGACCGGAA
4351 AGATTGCTGA TTATAATTAT AAACTCCCTG ATGATTTTAC CGGATGTGTT
4401 ATTGCTTGGA ACAGCAATAA CCTCGATAGT AAGGTCGGAG GAAACTATAA
4451 CTATTTGTAC AGACTGTTTA GAAAGTCGAA TTTGAAACCT TTTGAAAGAG
4501 ACATATCCAC CGAGATTTAC CAGGCGGGCA GCACACCGTG TAATGGTGTA
4551 GAAGGATTCA ATTGTTACTT TCCCCTGCAA TCATATGGGT TTCAACCAAC
4601 CAATGGAGTC GGATATCAAC CATATCGTGT CGTCGTCCTT TCCTTCGAGC
4651 TGCTTCATGC ACCAGCTACA GTCTGCGGAC CTAAGAAGAG CACTAATCTT
4701 GTCAAGAACA AATGTGTGAA CTTTAATTTT AATGGATTAA CAGGAACCGG
4751 AGTTTTGACC GAGAGTAATA AGAAGTTCTT GCCGTTCCAG CAATTTGGAC
4801 GAGACATTGC TGACACCACA GATGCGGTTC GTGACCCGCA AACTTTAGAG
4851 ATCCTAGACA TCACCCCATG TTCATTCGGT GGAGTTTCCG TTATTACTCC
4901 TGGAACGAAT ACAAGCAATC AAGTTGCCGT TCTCTATCAA GATGTTAATT
4951 GTACAGAAGT GCCTGTGGCC ATTCATGCAG ATCAACTAAC ACCAACTTGG
5001 AGAGTTTACA GCACTGGGTC CAATGTCTTC CAAACGCGCG CCGGCTGCCT
5051 CATTGGTGCA GAA TAT GTGA ATAACTCATA CGAATGTGAC ATTCCAATCG
5101 GTGCCGGCAT ATGCGCCTCT TACCAGACTC AGACTAATTC GCCAAGAAGA
5151 GCCAGGTCTG TCGCAAGTCA GTCAATTATT GCATACACAA TGTCGTTAGG
5201 AGCAGAGAAT AGTGTAGCAT ACTCAAACAA TTCTATAGCA ATACCTACCA
```

*Fig. 21G (cont.)*

```
5251  ACTTCACTAT ATCAGTAACT ACAGAAATAT TGCCAGTATC CATGACTAAA
5301  ACAAGTGTGG ATTGCACCAT GTACATCTGT GGAGATTCCA CAGAATGCAG
5351  CAATCTTCTC TTGCAATACG GATCATTCTG CACACAACTG AATAGGGCAC
5401  TGACTGGAAT TGCAGTCGAG CAGGATAAGA ACACACAGGA GGTGTTTGCC
5451  CAAGTCAAAC AAATATACAA AACACCACCC ATCAAGGATT TTGGAGGATT
5501  TAATTTCTCA CAAATACTCC CCGACCCATC CAAGCCCTCC AAAAGGAGTT
5551  TCATTGAGGA CCTCTTGTTT AATAAGGTTA CCTTGGCAGA TGCCGGGTTT
5601  ATTAAGCAGT ACGGCGACTG TCTTGGAGAC ATAGCAGCCA GAGATCTAAT
5651  TTGTGCCCAG AAATTCAATG GACTGACAGT CCTGCCTCCC TTATTAACTG
5701  ATGAGATGAT AGCTCAGTAT ACATCAGCAT TGTTGGCTGG TACAATTACA
5751  TCTGGATGGA CATTTGGTGC CGGAGCGGCA TTACAAATCC CTTTTGCAAT
5801  GCAAATGGCC TATAGATTTA ATGGAATCGG AGTAACTCAA AATGTTTAT
5851  ATGAGAATCA GAAATTAATT GCAAATCAAT TCAATTCAGC TATAGGAAAG
5901  ATTCAGGATT CACTCAGTAG TACAGCAAGC GCTCTAGGCA AATTACAAGA
5951  CGTCGTCAAT CAGAATGCAC AGGCATTAAA TACACTGGTG AAGCAATTGA
6001  GTTCCAATTT CGGAGCAATT TCATCTGTTC TAAATGATAT ATTGTCAAGA
6051  CTGGATAAAG TAGAAGCCGA GGTCCAAATC GATAGGCTGA TCACAGGAAG
6101  ACTTCAATCA CTACAGACAT ACGTCACCCA ACAACTCATC AGAGCAGCAG
6151  AAATTAGAGC CTCTGCTAAT CTAGCCGCAA CAAAGATGTC AGAGTGCGTA
6201  TTGGGACAAT CTAAGAGGGT CGACTTTTGT GGAAAGGGGT ATCACTTGAT
6251  GTCCTTTCCT CAATCTGCAC CACACGGAGT TGTCTTCTTA CATGTAACAT
6301  ATGTGCCCGC TCAAGAAAAG AATTTCACTA CAGCACCTGC AATATGTCAT
6351  GACGGAAAAG CACATTTTCC TCGGGAGGGA GTTTTCGTTT CTAATGGAAC
6401  CCATTGGTTC GTGACCCAAA GGAACTTTTA CGAGCCTCAA ATAATTACAA
6451  CTGATAATAC ATTCGTTTCT GGAAATTGCG ACGTAGTTAT AGGTATTGTA
6501  AATAATACTG TTTATGACCC TTTACAACCT GAACTCGATT CCTTCAAGGA
6551  AGAACTCGAC AAATATTTTA AGAATCACAC CTCACCGGAC GTTGACTTAG
6601  GAGACATTTC CGGGATTAAC GCTAGTGTAG TCAATATCCA AAAGGAGATA
6651  GATAGACTGA ATGAGGTAGC AAAGAATCTT AATGAATCTT TGATCGACCT
6701  TCAGGAGCTG GGGAAGTACG AACAATACAT AAAATGGCCA TGGTACATTT
6751  GGCTCGGGTT TATTGCTGGA CTAATTGCAA TAGTCATGGT CACTATCATG
6801  CTGTGTTGTA TGACATCGTG CTGCTCATGC CTCAAGGGAT GTTGTAGCTG
6851  TTGATCTTGT TGCAAGTTCG ATGAGGATGA TTCAGAACCA GTTTTAAAAG
6901  GAGTAAAGTT GCATTACACA TAAAGGCTAG CTGTTTACGC GTTATCCATG
6951  CTCAAAGAGG CCTCAATTAT ATTTGAGTTT TTAATTTTTA TGAAAAAAAC
7001  TAACAGCAAT CATGGAAGTC CACGATTTTG AGACCGACGA GTTCAATGAT
7051  TTCAATGAAG ATGACTATGC CACAAGAGAA TTCCTGAATC CGATGAGCG
7101  CATGACGTAC TTGAATCATG CTGATTACAA CCTGAATTCT CCTCTAATTA
7151  GTGATGATAT TGACAATTTA ATCAGGAAAT TCAATTCTCT TCCAATTCCC
7201  TCGATGTGGG ATAGTAAGAA CTGGGATGGA GTTCTTGAGA TGTTAACGTC
7251  ATGTCAAGCC AATCCCATCC CAACATCTCA GATGCATAAA TGGATGGGAA
7301  GTTGGTTAAT GTCTGATAAT CATGATGCCA GTCAAGGGTA TAGTTTTTTA
7351  CATGAAGTGG ACAAAGAGGC AGAAATAACA TTTGACGTGG TGGAGACCTT
7401  CATCCGCGGC TGGGGCAACA AACCAATTGA ATACATCAAA AAGGAAAGAT
7451  GGACTGACTC ATTCAAAATT CTCGCTTATT TGTGTCAAAA GTTTTTGGAC
7501  TTACACAAGT TGACATTAAT CTTAAATGCT GTCTCTGAGG TGGAATTGCT
7551  CAACTTGGCG AGGACTTTCA AAGGCAAAGT CAGAAGAAGT TCTCATGGAA
7601  CGAACATATG CAGGATTAGG GTTCCCAGCT TGGGTCCTAC TTTTATTTCA
7651  GAAGGATGGG CTTACTTCAA GAAACTTGAT ATTCTAATGG ACCGAAACTT
7701  TCTGTTAATG GTCAAAGATG TGATTATAGG GAGGATGCAA ACGGTGCTAT
7751  CCATGGTATG TAGAATAGAC AACCTGTTCT CAGAGCAAGA CATCTTCTCC
7801  CTTCTAAATA TCTACAGAAT TGGAGATAAA ATTGTGGAGA GGCAGGGAAA
7851  TTTTTCTTAT GACTTGATTA AAATGGTGGA ACCGATATGC AACTTGAAGC
```

*Fig. 21G (cont.)*

```
 7901  TGATGAAATT AGCAAGAGAA TCAAGGCCTT TAGTCCCACA ATTCCCTCAT
 7951  TTTGAAAATC ATATCAAGAC TTCTGTTGAT GAAGGGGCAA AAATTGACCG
 8001  AGGTATAAGA TTCCTCCATG ATCAGATAAT GAGTGTGAAA ACAGTGGATC
 8051  TCACACTGGT GATTATGGA TCGTTCAGAC ATTGGGGTCA TCCTTTTATA
 8101  GATTATTACA CTGGACTAGA AAAATTACAT TCCCAAGTAA CCATGAAGAA
 8151  AGATATTGAT GTGTCATATG CAAAAGCACT TGCAAGTGAT TTAGCTCGGA
 8201  TTGTTCTATT TCAACAGTTC AATGATCATA AAAGTGGTT CGTGAATGGA
 8251  GACTTGCTCC CTCATGATCA TCCCTTTAAA AGTCATGTTA AGAAAATAC
 8301  ATGGCCCACA GCTGCTCAAG TTCAAGATTT TGGAGATAAA TGGCATGAAC
 8351  TTCCGCTGAT TAAATGTTTT GAAATACCCG ACTTACTAGA CCCATCGATA
 8401  ATATACTCTG ACAAAAGTCA TTCAATGAAT AGGTCAGAGG TGTTGAAACA
 8451  TGTCCGAATG AATCCGAACA CTCCTATCCC TAGTAAAAAG GTGTTGCAGA
 8501  CTATGTTGGA CACAAAGGCT ACCAATTGGA AAGAATTTCT TAAAGAGATT
 8551  GATGAGAAGG GCTTAGATGA TGATGATCTA ATTATTGGTC TTAAAGGAAA
 8601  GGAGAGGGAA CTGAAGTTGG CAGGTAGATT TTTCTCCCTA ATGTCTTGGA
 8651  AATTGCGAGA ATACTTTGTA ATTACCGAAT ATTTGATAAA GACTCATTTC
 8701  GTCCCTATGT TTAAAGGCCT GACAATGGCG GACGATCTAA CTGCAGTCAT
 8751  TAAAAAGATG TTAGATTCCT CATCCGGCCA AGGATTGAAG TCATATGAGG
 8801  CAATTTGCAT AGCCAATCAC ATTGATTACG AAAAATGGAA TAACCACCAA
 8851  AGGAAGTTAT CAAACGGCCC AGTGTTCCGA GTTATGGGCC AGTTCTTAGG
 8901  TTATCCATCC TTAATCGAGA GAACTCATGA ATTTTTGAG AAAAGTCTTA
 8951  TATACTACAA TGGAAGACCA GACTTGATGC GTGTTCACAA CAACACACTG
 9001  ATCAATTCAA CCTCCCAACG AGTTTGTTGG CAAGGACAAG AGGGTGGACT
 9051  GGAAGGTCTA CGGCAAAAAG GATGGAGTAT CCTCAATCTA CTGGTTATTC
 9101  AAAGAGAGGC TAAAATCAGA AACACTGCTG TCAAAGTCTT GGCACAAGGT
 9151  GATAATCAAG TTATTTGCAC ACAGTATAAA ACGAAGAAAT CGAGAAACGT
 9201  TGTAGAATTA CAGGGTGCTC TCAATCAAAT GGTTTCTAAT AATGAGAAAA
 9251  TTATGACTGC AATCAAAATA GGGACAGGGA AGTTAGGACT TTTGATAAAT
 9301  GACGATGAGA CTATGCAATC TGCAGATTAC TTGAATTATG GAAAAATACC
 9351  GATTTTCCGT GGAGTGATTA GAGGGTTAGA GACCAAGAGA TGGTCACGAG
 9401  TGACTTGTGT CACCAATGAC CAAATACCCA CTTGTGCTAA TATAATGAGC
 9451  TCAGTTTCCA CAAATGCTCT CACCGTAGCT CATTTGCTG AGAACCCAAT
 9501  CAATGCCATG ATACAGTACA ATTATTTTGG GACATTTGCT AGACTCTTGT
 9551  TGATGATGCA TGATCCTGCT CTTCGTCAAT CATTGTATGA AGTTCAAGAT
 9601  AAGATACCAG GCTTGCACAG TTCTACTTTC AAATACGCCA TGTTGTATTT
 9651  GGACCCTTCC ATTGGAGGAG TGTCGGGCAT GTCTTTGTCC AGGTTTTTGA
 9701  TTAGAGCCTT CCCAGATCCC GTAACAGAAA GTCTCTCATT CTGGAGATTC
 9751  ATCCATGTAC ATGCTCGAAG TGAGCATCTG AAGGAGATGA GTGCAGTATT
 9801  TGGAAACCCC GAGATAGCCA GTTTCGAAT AACTCACATA GACAAGCTAG
 9851  TAGAAGATCC AACCTCTCTG AACATCGCTA TGGGAATGAG TCCAGCGAAC
 9901  TTGTTAAAGA CTGAGGTTAA AAAATGCTTA ATCGAATCAA GACAAACCAT
 9951  CAGGAACCAG GTGATTAAGG ATGCAACCAT ATATTTGTAT CATGAAGAGG
10001  ATCGGCTCAG AAGTTTCTTA TGGTCAATAA ATCCTCTGTT CCCTAGATTT
10051  TTAAGTGAAT TCAAATCAGG CACTTTTTTG GGAGTCGCAG ACGGGCTCAT
10101  CAGTCTATTT CAAAATTCTC GTACTATTCG GAACTCCTTT AAGAAAAAGT
10151  ATCATAGGGA ATTGGATGAT TTGATTGTGA GGAGTGAGGT ATCCTCTTTG
10201  ACACATTTAG GGAAACTTCA TTTGAGAAGG GGATCATGTA AAATGTGGAC
10251  ATGTTCAGCT ACTCATGCTG ACACATTAAG ATACAAATCC TGGGGCCGTA
10301  CAGTTATTGG GACAACTGTA CCCCATCCAT TAGAAATGTT GGGTCCACAA
10351  CATCGAAAAG AGACTCCTTG TGCACCATGT AACACATCAG GGTTCAATTA
10401  TGTTTCTGTG CATTGTCCAG ACGGGATCCA TGACGTCTTT AGTTCACGGG
10451  GACCATTGCC TGCTTATCTA GGGTCTAAAA CATCTGAATC TACATCTATT
10501  TTGCAGCCTT GGGAAAGGGA AAGCAAAGTC CCACTGATTA AAAGAGCTAC
```

*Fig. 21G (cont.)*

```
10551  ACGTCTTAGA GATGCTATCT CTTGGTTTGT TGAACCCGAC TCTAAACTAG
10601  CAATGACTAT ACTTTCTAAC ATCCACTCTT TAACAGGCGA AGAATGGACC
10651  AAAAGGCAGC ATGGGTTCAA AAGAACAGGG TCTGCCCTTC ATAGGTTTTC
10701  GACATCTCGG ATGAGCCATG GTGGGTTCGC ATCTCAGAGC ACTGCAGCAT
10751  TGACCAGGTT GATGGCAACT ACAGACACCA TGAGGGATCT GGGAGATCAG
10801  AATTTCGACT TTTTATTCCA AGCAACGTTG CTCTATGCTC AAATTACCAC
10851  CACTGTTGCA AGAGACGGAT GGATCACCAG TTGTACAGAT CATTATCATA
10901  TTGCCTGTAA GTCCTGTTTG AGACCCATAG AAGAGATCAC CCTGGACTCA
10951  AGTATGGACT ACACGCCCCC AGATGTATCC CATGTGCTGA AGACATGGAG
11001  GAATGGGGAA GGTTCGTGGG GACAAGAGAT AAAACAGATA TATCCTTTAG
11051  AAGGGAATTG GAAGAATTTA GCACCTGCTG AGCAATCCTA TCAAGTCGGC
11101  AGATGTATAG GTTTTCTATA TGGAGACTTG GCGTATAGAA AATCTACTCA
11151  TGCCGAGGAC AGTTCTCTAT TTCCTCTATC TATACAAGGT CGTATTAGAG
11201  GTCGAGGTTT CTTAAAAGGG TTGCTAGACG GATTAATGAG AGCAAGTTGC
11251  TGCCAAGTAA TACACCGGAG AAGTCTGGCT CATTTGAAGA GGCCGGCCAA
11301  CGCAGTGTAC GGAGGTTTGA TTTACTTGAT TGATAAATTG AGTGTATCAC
11351  CTCCATTCCT TTCTCTTACT AGATCAGGAC CTATTAGAGA CGAATTAGAA
11401  ACGATTCCCC ACAAGATCCC AACCTCCTAT CCGACAAGCA ACCGTGATAT
11451  GGGGGTGATT GTCAGAAATT ACTTCAAATA CCAATGCCGT CTAATTGAAA
11501  AGGGAAAATA CAGATCACAT TATTCACAAT TATGGTTATT CTCAGATGTC
11551  TTATCCATAG ACTTCATTGG ACCATTCTCT ATTTCCACCA CCCTCTTGCA
11601  AATCCTATAC AAGCCATTTT TATCTGGGAA AGATAAGAAT GAGTTGAGAG
11651  AGCTGGCAAA TCTTTCTTCA TTGCTAAGAT CAGGAGAGGG GTGGGAAGAC
11701  ATACATGTGA AATTCTTCAC CAAGGACATA TTATTGTGTC CAGAGGAAAT
11751  CAGACATGCT TGCAAGTTCG GGATTGCTAA GGATAATAAT AAAGACATGA
11801  GCTATCCCCC TTGGGGAAGG GAATCCAGAG GGACAATTAC AACAATCCCT
11851  GTTTATTATA CGACCACCCC TTACCCAAAG ATGCTAGAGA TGCCTCCAAG
11901  AATCCAAAAT CCCCTGCTGT CCGGAATCAG GTTGGGCCAA TTACCAACTG
11951  GCGCTCATTA TAAAATTCGG AGTATATTAC ATGGAATGGG AATCCATTAC
12001  AGGGACTTCT TGAGTTGTGG AGACGGCTCC GGAGGGATGA CTGCTGCATT
12051  ACTACGAGAA AATGTGCATA GCAGAGGAAT ATTCAATAGT CTGTTAGAAT
12101  TATCAGGGTC AGTCATGCGA GGCGCCTCTC CTGAGCCCCC CAGTGCCCTA
12151  GAAACTTTAG GAGGAGATAA ATCGAGATGT GTAAATGGTG AAACATGTTG
12201  GGAATATCCA TCTGACTTAT GTGACCCAAG GACTTGGGAC TATTTCCTCC
12251  GACTCAAAGC AGGCTTGGGG CTTCAAATTG ATTTAATTGT AATGGATATG
12301  GAAGTTCGGG ATTCTTCTAC TAGCCTGAAA ATTGAGACGA ATGTTAGAAA
12351  TTATGTGCAC CGGATTTTGG ATGAGCAAGG AGTTTTAATC TACAAGACTT
12401  ATGGAACATA TATTTGTGAG AGCGAAAAGA ATGCAGTAAC AATCCTTGGT
12451  CCCATGTTCA AGACGGTCGA CTTAGTTCAA ACAGAATTTA GTAGTTCTCA
12501  AACGTCTGAA GTATATATGG TATGTAAAGG TTTGAAGAAA TTAATCGATG
12551  AACCCAATCC CGATTGGTCT TCCATCAATG AATCCTGGAA AAACCTGTAC
12601  GCATTCCAGT CATCAGAACA GGAATTTGCC AGAGCAAAGA AGGTTAGTAC
12651  ATACTTTACC TTGACAGGTA TTCCCTCCCA ATTCATTCCT GATCCTTTTG
12701  TAAACATTGA GACTATGCTA CAAATATTCG GAGTACCCAC GGGTGTGTCT
12751  CATGCGGCTG CCTTAAAATC ATCTGATAGA CCTGCAGATT TATTGACCAT
12801  TAGCCTTTTT TATATGGCGA TTATATCGTA TTATAACATC AATCATATCA
12851  GAGTAGGACC GATACCTCCG AACCCCCCAT CAGATGGAAT TGCACAAAAT
12901  GTGGGGATCG CTATAACTGG TATAAGCTTT TGGCTGAGTT TGATGGAGAA
12951  AGACATTCCA CTATATCAAC AGTGTTTAGC AGTTATCCAG CAATCATTCC
13001  CGATTAGGTG GGAGGCTGTT TCAGTAAAAG GAGGATACAA GCAGAAGTGG
13051  AGTACTAGAG GTGATGGGCT CCCAAAAGAT ACCCGAATTT CAGACTCCTT
13101  GGCCCCAATC GGGAACTGGA TCAGATCTCT GGAATTGGTC CGAAACCAAG
13151  TTCGTCTAAA TCCATTCAAT GAGATCTTGT TCAATCAGCT ATGTCGTACA
```

*Fig. 21G (cont.)*

```
13201  GTGGATAATC ATTTGAAATG GTCAAATTTG CGAAGAAACA CAGGAATGAT
13251  TGAATGGATC AATAGACGAA TTTCAAAAGA AGACCGGTCT ATACTGATGT
13301  TGAAGAGTGA CCTACACGAG GAAAACTCTT GGAGAGATTA AAAAATCATG
13351  AGGAGACTCC AAACTTTAAG TATGAAAAAA ACTTTGATCC TTAAGACCCT
13401  CTTGTGGTTT TTATTTTTTA TCTGGTTTTG TGGTCTTCGT
```

*Fig. 21G (cont.)*

```
VSV-M
VSV-N  VSV-P  \ XhoI  NheI          VSV-L
```

Vector A without VSV-G
9606 bp

*Fig. 22A*

VSV-N amino acid sequence of Vector A (SEQ ID NO: 155)

MSVTVKRIIDNTVVVPKLPANEDPVEYPADYFRKSKEIPLYINTTKSLSDLRGYVYQG
LKSGNVSIIHVNSYLYGALKDIRGKLDKDWSSFGINIGKAGDTIGIFDLVSLKALDGV
LPDGVSDASRTSADDKWLPLYLLGLYRVGRTQMPEYRKKLMDGLTNQCKMINEQF
EPLVPEGRDIFDVWGNDSNYTKIVAAVDMFFHMFKKHECASFRYGTIVSRFKDCAA
LATFGHLCKITGMSTEDVTTWILNREVADEMVQMMLPGQEIDKADSYMPYLIDFGL
SSKSPYSSVKNPAFHFWGQLTALLLRSTRARNARQPDDIEYTSLTTAGLLYAYAVGS
SADLAQQFCVGDNKYTPDDSTGGLTTNAPPQGRDVVEWLGWFEDQNRKPTPDMM
QYAKRAVMSLQGLREKTIGKYAKSEFDK*

*Fig. 22B*

VSV-P amino acid sequence of Vector A (SEQ ID NO: 156)

MDNLTKVREYLKSYSRLDQAVGEIDEIEAQRAEKSNYELFQEDGVEEHTKPSYFQAA
DDSDTESEPEIEDNQGLYAPDPEAEQVEGFIQGPLDDYADEEVDVVFTSDWKQPELE
SDEHGKTLRLTSPEGLSGEQKSQWLSTIKAVVQSAKYWNLAECTFEASGEGVIMKER
QITPDVYKVTPVMNTHPSQSEAVSDVWSLSKTSMTFQPKKASLQPLTISLDELFSSRG
EFISVGGDGRMSHKEAILLGLRYKKLYNQARVKYSL*

*Fig. 22C*

VSV-M amino acid sequence of Vector A (SEQ ID NO: 157)

MSSLKKILGLKGKGKKSKKLGIAPPPYEEDTSMEYAPSAPIDKSYFGVDEMDTYDPN
QLRYEKFFFTVKMTVRSNRPFRTYSDVAAAVSHWDHMYIGMAGKRPFYKILAFLGS
SNLKATPAVLADQGQPEYHAHCEGRAYLPHRMGKTPPMLNVPEHFRRPFNIGLYKG
TIELTMTIYDDESLEAAPMIWDHFNSSKFSDFREKALMFGLIVEKKASGAWVLDSIGH
FK*

*Fig. 22D*

VSV-L amino acid sequence of Vector A (SEQ ID NO: 152)

MEVHDFETDEFNDFNEDDYATREFLNPDERMTYLNHADYNLNSPLISDDIDNLIRKF
NSLPIPSMWDSKNWDGVLEMLTSCQANPIPTSQMHKWMGSWLMSDNHDASQGYSF
LHEVDKEAEITFDVVETFIRGWGNKPIEYIKKERWTDSFKILAYLCQKFLDLHKLTLIL
NAVSEVELLNLARTFKGKVRRSSHGTNICRIRVPSLGPTFISEGWAYFKKLDILMDRN
FLLMVKDVIIGRMQTVLSMVCRIDNLFSEQDIFSLLNIYRIGDKIVERQGNFSYDLIKM
VEPICNLKLMKLARESRPLVPQFPHFENHIKTSVDEGAKIDRGIRFLHDQIMSVKTVD
LTLVIYGSFRHWGHPFIDYYTGLEKLHSQVTMKKDIDVSYAKALASDLARIVLFQQF
NDHKKWFVNGDLLPHDHPFKSHVKENTWPTAAQVQDFGDKWHELPLIKCFEIPDLL
DPSIIYSDKSHSMNRSEVLKHVRMNPNTPIPSKKVLQTMLDTKATNWKEFLKEIDEK
GLDDDDLIIGLKGKERELKLAGRFFSLMSWKLREYFVITEYLIKTHFVPMFKGLTMA
DDLTAVIKKMLDSSSGQGLKSYEAICIANHIDYEKWNNHQRKLSNGPVFRVMGQFL
GYPSLIERTHEFFEKSLIYYNGRPDLMRVHNNTLINSTSQRVCWQGQEGGLEGLRQK
GWSILNLLVIQREAKIRNTAVKVLAQGDNQVICTQYKTKKSRNVVELQGALNQMVS
NNEKIMTAIKIGTGKLGLLINDDETMQSADYLNYGKIPIFRGVIRGLETKRWSRVTCV
TNDQIPTCANIMSSVSTNALTVAHFAENPINAMIQYNYFGTFARLLLMMHDPALRQS
LYEVQDKIPGLHSSTFKYAMLYLDPSIGGVSGMSLSRFLIRAFPDPVTESLSFWRFIHV
HARSEHLKEMSAVFGNPEIAKFRITHIDKLVEDPTSLNIAMGMSPANLLKTEVKKCLI
ESRQTIRNQVIKDATIYLYHEEDRLRSFLWSINPLFPRFLSEFKSGTFLGVADGLISLFQ
NSRTIRNSFKKKYHRELDDLIVRSEVSSLTHLGKLHLRRGSCKMWTCSATHADTLRY
KSWGRTVIGTTVPHPLEMLGPQHRKETPCAPCNTSGFNYVSVHCPDGIHDVFSSRGP
LPAYLGSKTSESTSILQPWERESKVPLIKRATRLRDAISWFVEPDSKLAMTILSNIHSLT
GEEWTKRQHGFKRTGSALHRFSTSRMSHGGFASQSTAALTRLMATTDTMRDLGDQ
NFDFLFQATLLYAQITTTVARDGWITSCTDHYHIACKSCLRPIEEITLDSSMDYTPPDV
SHVLKTWRNGEGSWGQEIKQIYPLEGNWKNLAPAEQSYQVGRCIGFLYGDLAYRKS
THAEDSSLFPLSIQGRIRGRGFLKGLLDGLMRASCCQVIHRRSLAHLKRPANAVYGG
LIYLIDKLSVSPPFLSLTRSGPIRDELETIPHKIPTSYPTSNRDMGVIVRNYFKYQCRLIE
KGKYRSHYSQLWLFSDVLSIDFIGPFSISTTLLQILYKPFLSGKDKNELRELANLSSLLR
SGEGWEDIHVKFFTKDILLCPEEIRHACKFGIAKDNNKDMSYPPWGRESRGTITTIPV
YYTTTPYPKMLEMPPRIQNPLLSGIRLGQLPTGAHYKIRSILHGMGIHYRDFLSCGDG
SGGMTAALLRENVHSRGIFNSLLELSGSVMRGASPEPPSALETLGGDKSRCVNGETC
WEYPSDLCDPRTWDYFLRLKAGLGLQIDLIVMDMEVRDSSTSLKIETNVRNYVHRIL
DEQGVLIYKTYGTYICESEKNAVTILGPMFKTVDLVQTEFSSSQTSEVYMVCKGLKK
LIDEPNPDWSSINESWKNLYAFQSSEQEFARAKKVSTYFTLTGIPSQFIPDPFVNIETM
LQIFGVPTGVSHAAALKSSDRPADLLTISLFYMAIISYYNINHIRVGPIPPNPPSDGIAQ
NVGIAITGISFWLSLMEKDIPLYQQCLAVIQQSFPIRWEAVSVKGGYKQKWSTRGDG
LPKDTRISDSLAPIGNWIRSLELVRNQVRLNPFNEILFNQLCRTVDNHLKWSNLRRNT
GMIEWINRRISKEDRSILMLKSDLHEENSWRD*

Fig. 22E

Nucleotide sequence of Vector A (SEQ ID NO: 160)

```
   1  ACGAAGACAA ACAAACCATT ATTATCATTA AAAGGCTCAG GAGAAACTTT
  51  AACAGTAATC AAAATGTCTG TTACAGTCAA GAGAATCATT GACAACACAG
 101  TCGTAGTTCC AAAACTTCCT GCAAATGAGG ATCCAGTGGA ATACCCGGCA
 151  GATTACTTCA GAAAATCAAA GGAGATTCCT CTTTACATCA ATACTACAAA
 201  AAGTTTGTCA GATCTAAGAG GATATGTCTA CCAAGGCCTC AAATCCGGAA
 251  ATGTATCAAT CATACATGTC AACAGCTACT TGTATGGAGC ATTAAAGGAC
 301  ATCCGGGGTA AGTTGGATAA AGATTGGTCA AGTTTCGGAA TAAACATCGG
 351  GAAAGCAGGG GATACAATCG AATATTTGA CCTTGTATCC TTGAAAGCCC
 401  TGGACGGCGT ACTTCCAGAT GGAGTATCGG ATGCTTCCAG AACCAGCGCA
 451  GATGACAAAT GGTTGCCTTT GTATCTACTT GGCTTATACA GAGTGGGCAG
 501  AACACAAATG CCTGAATACA GAAAAAGCT CATGGATGGG CTGACAAATC
 551  AATGCAAAAT GATCAATGAA CAGTTTGAAC CTCTTGTGCC AGAAGGTCGT
 601  GACATTTTTG ATGTGTGGGG AAATGACAGT AATTACACAA AAATTGTCGC
 651  TGCAGTGGAC ATGTTCTTCC ACATGTTCAA AAAACATGAA TGTGCCTCGT
 701  TCAGATACGG AACTATTGTT TCCAGATTCA AGATTGTGC TGCATTGGCA
 751  ACATTTGGAC ACCTCTGCAA AATAACCGGA ATGTCTACAG AAGATGTAAC
 801  GACCTGGATC TTGAACCGAG AAGTTGCAGA TGAAATGGTC CAAATGATGC
 851  TTCCAGGCCA AGAAATTGAC AAGGCCGATT CATACATGCC TTATTTGATC
 901  GACTTTGGAT TGTCTTCTAA GTCTCCATAT TCTTCCGTCA AAACCCTGC
 951  CTTCCACTTC TGGGGGCAAT TGACAGCTCT TCTGCTCAGA TCCACCAGAG
1001  CAAGGAATGC CCGACAGCCT GATGACATTG AGTATACATC TCTTACTACA
1051  GCAGGTTTGT TGTACGCTTA TGCAGTAGGA TCCTCTGCCG ACTTGGCACA
1101  ACAGTTTTGT GTTGGAGATA ACAAATACAC TCCAGATGAT AGTACCGGAG
1151  GATTGACGAC TAATGCACCG CCACAAGGCA GAGATGTGGT CGAATGGCTC
1201  GGATGGTTTG AAGATCAAAA CAGAAAACCG ACTCCTGATA TGATGCAGTA
1251  TGCGAAAAGA GCAGTCATGT CACTGCAAGG CCTAAGAGAG AAGACAATTG
1301  GCAAGTATGC TAAGTCAGAA TTTGACAAAT GACCCTATAA TTCTCAGATC
1351  ACCTATTATA TATTATGCTA CATATGAAAA AAACTAACAG ATATCATGGA
1401  TAATCTCACA AAAGTTCGTG AGTATCTCAA GTCCTATTCT CGTCTGGATC
1451  AGGCGGTAGG AGAGATAGAT GAGATCGAAG CACAACGAGC TGAAAAGTCC
1501  AATTATGAGT TGTTCCAAGA GGATGGAGTG GAAGAGCATA CTAAGCCCTC
1551  TTATTTTCAG GCAGCAGATG ATTCTGACAC AGAATCTGAA CCAGAAATTG
1601  AAGACAATCA AGGCTTGTAT GCACCAGATC CAGAAGCTGA GCAAGTTGAA
1651  GGCTTTATAC AGGGGCCTTT AGATGACTAT GCAGATGAGG AAGTGGATGT
1701  TGTATTTACT TCGGACTGGA AACAGCCTGA GCTTGAATCT GACGAGCATG
1751  GAAAGACCTT ACGGTTGACA TCGCCAGAGG GTTTAAGTGG AGAGCAGAAA
1801  TCCCAGTGGC TTTCGACGAT TAAAGCAGTC GTGCAAAGTG CCAAATACTG
1851  GAATCTGGCA GAGTGCACAT TTGAAGCATC GGGAGAAGGG GTCATTATGA
1901  AGGAGCGCCA GATAACTCCG GATGTATATA AGGTCACTCC AGTGATGAAC
1951  ACACATCCGT CCCAATCAGA AGCAGTATCA GATGTTTGGT CTCTCTCAAA
2001  GACATCCATG ACTTTCCAAC CCAAGAAAGC AAGTCTTCAG CCTCTCACCA
2051  TATCCTTGGA TGAATTGTTC TCATCTAGAG GAGAGTTCAT CTCTGTCGGA
2101  GGTGACGGAC GAATGTCTCA TAAAGAGGCC ATCCTGCTCG GCCTGAGATA
2151  CAAAAAGTTG TACAATCAGG CGAGAGTCAA ATATTCTCTG TAGACTATGA
2201  AAAAAAGTAA CAGATATCAC GATCTAAGTG TTATCCCAAT CCATTCATCA
2251  TGAGTTCCTT AAAGAAGATT CTCGGTCTGA AGGGGAAAGG TAAGAAATCT
2301  AAGAAATTAG GGATCGCACC ACCCCCTTAT GAAGAGGACA CTAGCATGGA
2351  GTATGCTCCG AGCGCTCCAA TTGACAAATC CTATTTTGGA GTTGACGAGA
2401  TGGACACCTA TGATCCGAAT CAATTAAGAT ATGAGAAATT CTTCTTTACA
2451  GTGAAAATGA CGGTTAGATC TAATCGTCCG TTCAGAACAT ACTCAGATGT
2501  GGCAGCCGCT GTATCCCATT GGGATCACAT GTACATCGGA ATGGCAGGGA
2551  AACGTCCCTT CTACAAAATC TTGGCTTTTT TGGGTTCTTC TAATCTAAAG
2601  GCCACTCCAG CGGTATTGGC AGATCAAGGT CAACCAGAGT ATCACGCTCA
```

*Fig. 22F*

```
2651  CTGCGAAGGC AGGGCTTATT TGCCACATAG GATGGGGAAG ACCCCTCCCA
2701  TGCTCAATGT ACCAGAGCAC TTCAGAAGAC CATTCAATAT AGGTCTTTAC
2751  AAGGGAACGA TTGAGCTCAC AATGACCATC TACGATGATG AGTCACTGGA
2801  AGCAGCTCCT ATGATCTGGG ATCATTTCAA TTCTTCCAAA TTTTCTGATT
2851  TCAGAGAGAA GGCCTTAATG TTTGGCCTGA TTGTCGAGAA AAAGGCATCT
2901  GGAGCGTGGG TCCTGGACTC TATCGGCCAC TTCAAATGAG CTAGTCTAAC
2951  TTCTAGCTTC TGAACAATCC CCGGTTTACT CAGTCTCCCC TAATTCCAGC
3001  CTCTCGAACA ACTAATATCC TGTCTTTTCT ATCCCTATGA AAAAACTAA
3051  CAGAGATCGA TCTGTTTACG CGCTAGTGGA TCCTACTCGA GGCTAGCTGT
3101  TTACGCGTTA TCCATGCTCA AAGAGGCCTC AATTATATTT GAGTTTTTAA
3151  TTTTTATGAA AAAACTAAC AGCAATCATG GAAGTCCACG ATTTTGAGAC
3201  CGACGAGTTC AATGATTTCA ATGAAGAGCA CTATGCCACA AGAGAATTCC
3251  TGAATCCCGA TGAGCGCATG ACGTACTTGA ATCATGCTGA TTACAACCTG
3301  AATTCTCCTC TAATTAGTGA TGATATTGAC AATTTAATCA GGAAATTCAA
3351  TTCTCTTCCA ATTCCCTCGA TGTGGGATAG TAAGAACTGG GATGGAGTTC
3401  TTGAGATGTT AACGTCATGT CAAGCCAATC CCATCCCAAC ATCTCAGATG
3451  CATAAATGGA TGGGAAGTTG GTTAATGTCT GATAATCATG ATGCCAGTCA
3501  AGGGTATAGT TTTTTACATG AAGTGGACAA AGAGGCAGAA ATAACATTTG
3551  ACGTGGTGGA GACCTTCATC CGCGGCTGGG GCAACAAACC AATTGAATAC
3601  ATCAAAAAGG AAAGATGGAC TGACTCATTC AAAATTCTCG CTTATTTGTG
3651  TCAAAAGTTT TTGGACTTAC ACAAGTTGAC ATTAATCTTA AATGCTGTCT
3701  CTGAGGTGGA ATTGCTCAAC TTGGCGAGGA CTTTCAAAGG CAAAGTCAGA
3751  AGAAGTTCTC ATGGAACGAA CATATGCAGG ATTAGGGTTC CCAGCTTGGG
3801  TCCTACTTTT ATTTCAGAAG GATGGGCTTA CTTCAAGAAA CTTGATATTC
3851  TAATGGACCG AAACTTTCTG TTAATGGTCA AGATGTGAT TATAGGGAGG
3901  ATGCAAACGG TGCTATCCAT GGTATGTAGA ATAGACAACC TGTTCTCAGA
3951  GCAAGACATC TTCTCCCTTC TAAATATCTA CAGAATTGGA GATAAAATTG
4001  TGGAGAGGCA GGGAAATTTT TCTTATGACT TGATTAAAAT GGTGGAACCG
4051  ATATGCAACT TGAAGCTGAT GAAATTAGCA AGAGAATCAA GGCCTTTAGT
4101  CCCACAATTC CCTCATTTTG AAAATCATAT CAAGACTTCT GTTGATGAAG
4151  GGGCAAAAAT TGACCGAGGT ATAAGATTCC TCCATGATCA GATAATGAGT
4201  GTGAAAACAG TGGATCTCAC ACTGGTGATT TATGGATCGT TCAGACATTG
4251  GGGTCATCCT TTTATAGATT ATTACACTGG ACTAGAAAAA TTACATTCCC
4301  AAGTAACCAT GAAGAAAGAT ATTGATGTGT CATATGCAAA AGCACTTGCA
4351  AGTGATTTAG CTCGGATTGT TCTATTTCAA CAGTTCAATG ATCATAAAAA
4401  GTGGTTCGTG AATGGAGACT TGCTCCCTCA TGATCATCCC TTTAAAAGTC
4451  ATGTTAAAGA AAATACATGG CCCACAGCTG CTCAAGTTCA AGATTTTGGA
4501  GATAAATGGC ATGAACTTCC GCTGATTAAA TGTTTTGAAA TACCCGACTT
4551  ACTAGACCCA TCGATAATAT ACTCTGACAA AAGTCATTCA ATGAATAGGT
4601  CAGAGGTGTT GAAACATGTC CGAATGAATC CGAACACTCC TATCCCTAGT
4651  AAAAAGGTGT TGCAGACTAT GTTGGACACA AAGGCTACCA ATTGGAAAGA
4701  ATTTCTTAAA GAGATTGATG AGAAGGGCTT AGATGATGAT GATCTAATTA
4751  TTGGTCTTAA AGGAAGGAG AGGGAACTGA AGTTGGCAGG TAGATTTTTC
4801  TCCCTAATGT CTTGGAAATT GCGAGAATAC TTTGTAATTA CCGAATATTT
4851  GATAAAGACT CATTTCGTCC CTATGTTTAA AGGCCTGACA ATGGCGGACG
4901  ATCTAACTGC AGTCATTAAA AAGATGTTAG ATTCCTCATC CGGCCAAGGA
4951  TTGAAGTCAT ATGAGGCAAT TTGCATAGCC AATCACATTG ATTACGAAAA
5001  ATGGAATAAC CACCAAGGA AGTTATCAAA CGGCCCAGTG TTCCGAGTTA
5051  TGGGCCAGTT CTTAGGTTAT CCATCCTTAA TCGAGAGAAC TCATGAATTT
5101  TTTGAGAAAA GTCTTATATA CTACAATGGA AGACCAGACT TGATGCGTGT
5151  TCACAACAAC ACACTGATCA ATTCAACCTC CAACAGAGTT TGTTGGCAAG
5201  GACAAGAGGG TGGACTGGAA GGTCTACGGC AAAAAGGATG GAGTATCCTC
```

*Fig. 22F (cont.)*

```
5251  AATCTACTGG TTATTCAAAG AGAGGCTAAA ATCAGAAACA CTGCTGTCAA
5301  AGTCTTGGCA CAAGGTGATA ATCAAGTTAT TTGCACACAG TATAAAACGA
5351  AGAAATCGAG AAACGTTGTA GAATTACAGG GTGCTCTCAA TCAAATGGTT
5401  TCTAATAATG AGAAAATTAT GACTGCAATC AAAATAGGGA CAGGGAAGTT
5451  AGGACTTTTG ATAAATGACG ATGAGACTAT GCAATCTGCA GATTACTTGA
5501  ATTATGGAAA ATACCGATT TTCCGTGGAG TGATTAGAGG GTTAGAGACC
5551  AAGAGATGGT CACGAGTGAC TTGTGTCACC AATGACCAAA TACCCACTTG
5601  TGCTAATATA ATGAGCTCAG TTTCCACAAA TGCTCTCACC GTAGCTCATT
5651  TTGCTGAGAA CCCAATCAAT GCCATGATAC AGTACAATTA TTTTGGGACA
5701  TTTGCTAGAC TCTTGTTGAT GATGCATGAT CCTGCTCTTC GTCAATCATT
5751  GTATGAAGTT CAAGATAAGA TACCAGGCTT GCACAGTTCT ACTTTCAAAT
5801  ACGCCATGTT GTATTTGGAC CCTTCCATTG GAGGAGTGTC GGGCATGTCT
5851  TTGTCCAGGT TTTTGATTAG AGCCTTCCCA GATCCCGTAA CAGAAAGTCT
5901  CTCATTCTGG AGATTCATCC ATGTACATGC TCGAAGTGAG CATCTGAAGG
5951  AGATGAGTGC AGTATTTGGA AACCCCGAGA TAGCCAAGTT TCGAATAACT
6001  CACATAGACA AGCTAGTAGA AGATCCAACC TCTCTGAACA TCGCTATGGG
6051  AATGAGTCCA GCGAACTTGT TAAAGACTGA GGTTAAAAAA TGCTTAATCG
6101  AATCAAGACA AACCATCAGG AACCAGGTGA TTAAGGATGC AACCATATAT
6151  TTGTATCATG AAGAGGATCG GCTCAGAAGT TTCTTATGGT CAATAAATCC
6201  TCTGTTCCCT AGATTTTAA GTGAATTCAA ATCAGGCACT TTTTTGGGAG
6251  TCGCAGACGG GCTCATCAGT CTATTTCAAA ATTCTCGTAC TATTCGGAAC
6301  TCCTTTAAGA AAAAGTATCA TAGGGAATTG GATGATTTGA TTGTGAGGAG
6351  TGAGGTATCC TCTTTGACAC ATTTAGGGAA ACTTCATTTG AGAAGGGGAT
6401  CATGTAAAAT GTGGACATGT TCAGCTACTC ATGCTGACAC ATTAAGATAC
6451  AAATCCTGGG GCCGTACAGT TATTGGGACA ACTGTACCCC ATCCATTAGA
6501  AATGTTGGGT CCACAACATC GAAAAGAGAC TCCTTGTGCA CCATGTAACA
6551  CATCAGGGTT CAATTATGTT TCTGTGCATT GTCCAGACGG GATCCATGAC
6601  GTCTTTAGTT CACGGGACC ATTGCCTGCT TATCTAGGGT CTAAAACATC
6651  TGAATCTACA TCTATTTTGC AGCCTTGGGA AAGGGAAAGC AAAGTCCCAC
6701  TGATTAAAAG AGCTACACGT CTTAGAGATG CTATCTCTTG GTTTGTTGAA
6751  CCCGACTCTA AACTAGCAAT GACTATACTT TCTAACATCC ACTCTTTAAC
6801  AGGCGAAGAA TGGACCAAAA GGCAGCATGG GTTCAAAAGA CAGGGTCTG
6851  CCCTTCATAG GTTTTCGACA TCTCGGATGA GCCATGGTGG GTTCGCATCT
6901  CAGAGCACTG CAGCATTGAC CAGGTTGATG GCAACTACAG ACACCATGAG
6951  GGATCTGGGA GATCAGAATT TCGACTTTTT ATTCCAAGCA ACGTTGCTCT
7001  ATGCTCAAAT TACCACCACT GTTGCAAGAG ACGGATGGAT CACCAGTTGT
7051  ACAGATCATT ATCATATTGC CTGTAAGTCC TGTTTGAGAC CCATAGAAGA
7101  GATCACCCTG GACTCAAGTA TGGACTACAC GCCCCAGAT GTATCCCATG
7151  TGCTGAAGAC ATGGAGGAAT GGGGAAGGTT CGTGGGGACA AGAGATAAAA
7201  CAGATCTATC CTTTAGAAGG GAATTGGAAG AATTTAGCAC CTGCTGAGCA
7251  ATCCTATCAA GTCGGCAGAT GTATAGGTTT TCTATATGGA GACTTGGCGT
7301  ATAGAAAATC TACTCATGCC GAGGACAGTT CTCTATTTCC TCTATCTATA
7351  CAAGGTCGTA TTAGAGGTCG AGGTTTCTTA AAAGGGTTGC TAGACGGATT
7401  AATGAGAGCA AGTTGCTGCC AAGTAATACA CCGGAGAAGT CTGGCTCATT
7451  TGAAGAGGCC GGCCAACGCA GTGTACGGAG GTTTGATTTA CTTGATTGAT
7501  AAATTGAGTG TATCACCTCC ATTCCTTTCT CTTACTAGAT CAGGACCTAT
7551  TAGAGACGAA TTAGAAACGA TTCCCCACAA GATCCCAACC TCCTATCCGA
7601  CAAGCAACCG TGATATGGGG GTGATTGTCA GAAATTACTT CAAATACCAA
7651  TGCCGTCTAA TTGAAAAGGG AAAATACAGA TCACATTATT CACAATTATG
7701  GTTATTCTCA GATGTCTTAT CCATAGACTT CATTGGACCA TTCTCTATTT
7751  CCACCACCCT CTTGCAAATC CTATACAAGC CATTTTTATC TGGGAAAGAT
```

*Fig. 22F (cont.)*

```
7801  AAGAATGAGT TGAGAGAGCT GGCAAATCTT TCTTCATTGC TAAGATCAGG
7851  AGAGGGGTGG GAAGACATAC ATGTGAAATT CTTCACCAAG GACATATTAT
7901  TGTGTCCAGA GGAAATCAGA CATGCTTGCA AGTTCGGGAT TGCTAAGGAT
7951  AATAATAAAG ACATGAGCTA TCCCCCTTGG GGAAGGGAAT CCAGAGGGAC
8001  AATTACAACA ATCCCTGTTT ATTATACGAC CACCCCTTAC CCAAAGATGC
8051  TAGAGATGCC TCCAAGAATC CAAAATCCCC TGCTGTCCGG AATCAGGTTG
8101  GGCCAATTAC CAACTGGCGC TCATTATAAA ATTCGGAGTA TATTACATGG
8151  AATGGGAATC CATTACAGGG ACTTCTTGAG TTGTGGAGAC GGCTCCGGAG
8201  GGATGACTGC TGCATTACTA CGAGAAAATG TGCATAGCAG AGGAATATTC
8251  AATAGTCTGT TAGAATTATC AGGGTCAGTC ATGCGAGGCG CCTCTCCTGA
8301  GCCCCCCAGT GCCCTAGAAA CTTTAGGAGG AGATAAATCG AGATGTGTAA
8351  ATGGTGAAAC ATGTTGGGAA TATCCATCTG ACTTATGTGA CCCAAGGACT
8401  TGGGACTATT TCCTCCGACT CAAAGCAGGC TTGGGGCTTC AAATTGATTT
8451  AATTGTAATG GATATGGAAG TTCGGGATTC TTCTACTAGC CTGAAAATTG
8501  AGACGAATGT TAGAAATTAT GTGCACCGGA TTTTGGATGA GCAAGGAGTT
8551  TTAATCTACA AGACTTATGG AACATATATT TGTGAGAGCG AAAAGAATGC
8601  AGTAACAATC CTTGGTCCCA TGTTCAAGAC GGTCGACTTA GTTCAAACAG
8651  AATTTAGTAG TTCTCAAACG TCTGAAGTAT ATATGGTATG TAAAGGTTTG
8701  AAGAAATTAA TCGATGAACC CAATCCCGAT TGGTCTTCCA TCAATGAATC
8751  CTGGAAAAAC CTGTACGCAT TCCAGTCATC AGAACAGGAA TTTGCCAGAG
8801  CAAAGAAGGT TAGTACATAC TTTACCTTGA CAGGTATTCC CTCCCAATTC
8851  ATTCCTGATC CTTTTGTAAA CATTGAGACT ATGCTACAAA TATTCGGAGT
8901  ACCCACGGGT GTGTCTCATG CGGCTGCCTT AAAATCATCT GATAGACCTG
8951  CAGATTTATT GACCATTAGC CTTTTTTATA TGGCGATTAT ATCGTATTAT
9001  AACATCAATC ATATCAGAGT AGGACCGATA CCTCCGAACC CCCCATCAGA
9051  TGGAATTGCA CAAAATGTGG GGATCGCTAT AACTGGTATA AGCTTTTGGC
9101  TGAGTTTGAT GGAGAAAGAC ATTCCACTAT ATCAACAGTG TTTAGCAGTT
9151  ATCCAGCAAT CATTCCCGAT TAGGTGGGAG GCTGTTTCAG TAAAAGGAGG
9201  ATACAAGCAG AAGTGGAGTA CTAGAGGTGA TGGGCTCCCA AAAGATACCC
9251  GAATTTCAGA CTCCTTGGCC CCAATCGGGA ACTGGATCAG ATCTCTGGAA
9301  TTGGTCCGAA ACCAAGTTCG TCTAAATCCA TTCAATGAGA TCTTGTTCAA
9351  TCAGCTATGT CGTACAGTGG ATAATCATTT GAAATGGTCA AATTTGCGAA
9401  GAAACACAGG AATGATTGAA TGGATCAATA GACGAATTTC AAAAGAAGAC
9451  CGGTCTATAC TGATGTTGAA GAGTGACCTA CACGAGGAAA ACTCTTGGAG
9501  AGATTAAAAA ATCATGAGGA GACTCCAAAC TTTAAGTATG AAAAAAACTT
9551  TGATCCTTAA GACCCTCTTG TGGTTTTTAT TTTTTATCTG GTTTTGTGGT
9601  CTTCGT
```

*Fig. 22F (cont.)*

Vector B without VSV-G
9490 bp

Fig. 23A

VSV-N amino acid sequence of Vector B (SEQ ID NO: 155)

MSVTVKRIIDNTVIVPKLPANEDPVEYPADYFRKSKEIPLYINTTKSLSDLRGYVYQG
LKSGNVSIIHVNSYLYGALKDIRGKLDKDWSSFGINIGKAGDTIGIFDLVSLKALDGV
LPDGVSDASRTSADDKWLPLYLLGLYRVGRTQMPEYRKRLMDGLTNQCKMINEQF
EPLVPEGRDIFDVWGNDSNYTKIVAAVDMFFHMFKKHECASFRYGTIVSRFKDCAA
LATFGHLCKITGMSTEDVTTWILNREVADEMVQMMLPGQEIDKADSYMPYLIDFGL
SSKSPYSSVKNPAFHFWGQLTALLLRSTRARNARQPDDIEYTSLTTAGLLYAYAVGS
SADLAQQFCVGDSKYTPDDSTGGLTTNAPPQGRDVVEWLGWFEDQNRKPTPDMMQ
YAKRAVMSLQGLREKTIGKYAKSEFDK*

Fig. 23B

VSV-P amino acid sequence of Vector B (SEQ ID NO: 156)

MDNLTKVREYLKSYSRLDQAVGEIDEIEAQRAEKSNYELFQEDGVEEHTRPSYFQAA
DDSDTESEPEIEDNQGLYVPDPEAEQVEGFIQGPLDDYADEDVDVVFTSDWKQPELE
SDEHGKTLRLTLPEGLSGEQKSQWLLTIKAVVQSAKHWNLAECTFEASGEGVIIKKR
QITPDVYKVTPVMNTHPSQSEAVSDVWSLSKTSMTFQPKKASLQPLTISLDELFSSRG
EFISVGGNGRMSHKEAILLGLRYKKLYNQARVKYSL*

Fig. 23C

VSV-M amino acid sequence of Vector B (SEQ ID NO: 157)

MSSLKKILGLKGKGKKSKKLGIAPPPYEEDTNMEYAPSAPIDKSYFGVDEMDTHDPN
QLRYEKFFFTVKMTVRSNRPFRTYSDVAAAVSHWDHMYIGMAGKRPFYKILAFLGS
SNLKATPAVLADQGQPEYHAHCEGRAYLPHRMGKTPPMLNVPEHFRRPFNIGLYKG
TIELTMTIYDDESLEAAPMIWDHFNSSKFSDFREKALMFGLIVEKKASGAWVLDSVS
HFK*

Fig. 23D

VSV-L amino acid sequence of Vector B (SEQ ID NO: 152)

MEVHDFETDEFNDFNEDDYATREFLNPDERMTYLNHADYNLNSPLISDDIDNLIRKF
NSLPIPSMWDSKNWDGVLEMLTSCQANPISTSQMHKWMGSWLMSDNHDARQGYS
FLHEVDKEAEITFDVVETFIRGWGNKPIEYIKKERWTDSFKILAYLCQKFLDLHKLTLI
LNAVSEVELLNLARTFKGKVRRSSHGTNICRLRVPSLGPTFISEGWAYFKKLDILMDR
NFLLMVKDVIIGRMQTVLSMVCRIDNLFSEQDIFSLLNIYRIGDKIVERQGNFSYDLIK
MVEPICNLKLMKLARESRPLVPQFPHFENHIKTSVDEGAKIDRGIRFLHDQIMSVKTV
DLTLVIYGSFRHWGHPFIDYYAGLEKLHSQVTMKKDIDVSYAKALASDLARIVLFQQ
FNDHKKWFVNGDLLPHDHPFKSHVKENTWPTAAQVQDFGDKWHELPLIKCFEIPDL
LDPSIIYSDKSHSMNRSEVLKHVRMNPNTPIPSKKVLQTMLDTKATNWKEFLKEIDE
KGLDDDDLIIGLKGKERELKLAGRFFSLMSWKLREYFVITEYLIKTHFVPMFKGLTM
ADDLTAVIKKMLDSSSGQGLKSYEAICIANHIDYEKWNNHQRKLSNGPVFRVMGQF
LGYPSLIERTHEFFEKSLIYYNGRPDLMRVHNNTLINSTSQRVCWQGQEGGLEGLRQ
KGWSILNLLVIQREAKIRNTAVKVLAQGDNQVICTQYKTKKSRNVVELQGALNQMV
SNNEKIMTAIKIGTGKLGLLINDDETMQSADYLNYGKIPIFRGVIRGLETKRWSRVTC
VTNDQIPTCANIMSSVSTNALTVAHFAENPINAMIQYNYFGTFARLLLMMHDPALRQ
SLYEVQDKIPGLHSSTFKYAMLYLDPSIGGVSGMSLSRFLIRAFPDPVTESLSFWRFIH
VHARSEHLKEMSAVFGNPEIAKFRITHIDKLVEDPTSLNIAMGMSPANLLKTEVKKCL
IESRQTIRNQVIKDATIYLYHEEDRLRSFLWSINPLFPRFLSEFKSGTFLGVADGLISLF
QNSRTIRNSFKKKYHRELDDLIVRSEVSSLTHLGKLHLRRGSCKMWTCSATHADTLR
YKSWGRTVIGTTVPHPLEMLGPQHRKETPCAPCNTSGFNYVSVHCPDGIHDVFSSRG
PLPAYLGSKTSESTSILQPWERESKVPLIKRATRLRDAISWFVEPDSKLAMTILSNIHSL
TGEEWTERQHGFKRTGSALHRFSTSRMSHGGFASQSTAALTRLMATTDTMRDLGDQ
NFDFLFQATLLYAQITTTVARDGWITSCTDHYHIACKSCLRPIEEITLDSSMDYTPPDV
SHVLKTWRNGEGSWGQEIKQIYPLEGNWKNLAPAEQSYQVGRCIGFLYGDLAYRKS
THAEDSSLFPLSIQGRIRGRGFLKGLLDGLMRASCCQVIHRRSLAHLKRPANAVYGG
LIYLIDKLSVSPPFLSLTRSGPIRDELETIPHKIPTSYPTSNRDMGVIVRNYFKYQCRLIE
KGKYRSHYSQLWLFSDVLSIDFIGPFSISTTLLQILYKPFLSGKDKNELRELANLSSLLR
SGEGWEDIHVKFFTKDILLCPEEIRHACKFGIAKDNNKDMSYPPWGRESRGTITTIPV
YYTTTPYPKMLEMPPRIQNPLLSGIRLGQLPTGAHYKIRSILHGMGIHYRDFLSCGDG
SGGMTAALLRENVHSRGIFNSLLELSGSVMRGASPEPPSALETLGGDKSRCVNGETC
WEYPSDLCDPRTWDYFLRLKAGLGLQIDLIVMDMEVRDSSTSLKIETNVRNYVHRIL
DEQGVLIYKTYGTYICESEKNAVTILGPMFKTVDLVQTEFSSSQTSEVYMVCKGLKK
LIDEPNPDWSSINESWKNLYAFQSSEQEFARAKKVSTYFTLTGIPSQFIPDPFVNIETM
LQIFGVPTGVSHAAALKSSDRPADLLTISLFYMAIISYYNINHIRVGPIPPNPPSDGIAQ
NVGIAITGISFWLSLMEKDIPLYQQCLAVIQQSFPIRWEAVSVKGGYKQKWSTRGDG
LPKDTRISDSLAPIGNWIRSLELVRNQVRLNPFNEILFNQLCRTVDNHLKWSNLRKNT
GMIEWINRRISKEDRSILMLKSDLHEENSWRD*

Fig. 23E

Nucleotide sequence of Vector B (SEQ ID NO: 161)

```
   1  ACGAAGACAA ACAAACCATT ATTATCATTA AAAGGCTCAG GAGAAACTTT
  51  AACAGTAATC AAAATGTCTG TTACAGTCAA GAGAATCATT GACAACACAG
 101  TCATAGTTCC AAAACTTCCT GCAAATGAGG ATCCAGTGGA ATACCCGGCA
 151  GATTACTTCA GAAAATCAAA GGAGATTCCT CTTTACATCA ATACTACAAA
 201  AAGTTTGTCA GATCTAAGAG GATATGTCTA CCAAGGCCTC AAATCCGGAA
 251  ATGTATCAAT CATACATGTC AACAGCTACT TGTATGGAGC ATTGAAGGAC
 301  ATCCGGGGTA AGTTGGATAA AGATTGGTCA AGTTTCGGAA TAAACATCGG
 351  GAAGGCAGGG GATACAATCG AATATTTGA CCTTGTATCC TTGAAAGCCC
 401  TGGACGGTGT ACTTCCAGAT GGAGTATCGG ATGCTTCCAG AACCAGCGCA
 451  GATGACAAAT GGTTGCCTTT GTATCTACTT GGCTTATACA GAGTGGGCAG
 501  AACACAAATG CCTGAATACA GAAAAAGGCT CATGGATGGG CTGACAAATC
 551  AATGCAAAAT GATCAATGAA CAGTTTGAAC CTCTTGTGCC AGAAGGTCGT
 601  GACATTTTTG ATGTGTGGGG AAATGACAGT AATTACACAA AAATTGTCGC
 651  TGCAGTGGAC ATGTTCTTCC ACATGTTCAA AAAACATGAA TGTGCCTCGT
 701  TCAGATACGG AACTATTGTT TCCAGATTCA AGATTGTGC TGCATTGGCA
 751  ACATTTGGAC ACCTCTGCAA AATAACCGGA ATGTCTACAG AAGATGTGAC
 801  GACCTGGATC TTGAACCGAG AAGTTGCAGA TGAGATGGTC AAATGATGC
 851  TTCCAGGCCA AGAAATTGAC AAGGCTGATT CATACATGCC TTATTTGATC
 901  GACTTTGGAT TGTCTTCTAA GTCTCCATAT TCTTCCGTCA AAAACCCTGC
 951  CTTCCACTTC TGGGGGCAAT TGACAGCTCT TCTGCTCAGA TCCACCAGAG
1001  CAAGGAATGC CCGACAGCCT GATGACATTG AGTATACATC TCTTACTACA
1051  GCAGGTTTGT TGTACGCTTA TGCAGTAGGA TCCTCTGCTG ACTTGGCACA
1101  ACAGTTTTGT GTTGGAGATA GCAAATACAC TCCAGATGAT AGTACCGGAG
1151  GATTGACGAC TAATGCACCG CCACAAGGCA GAGATGTGGT CGAATGGCTC
1201  GGATGGTTTG AAGATCAAAA CAGAAACCG ACTCCTGATA TGATGCAGTA
1251  TGCGAAACGA GCAGTCATGT CACTGCAAGG CCTAAGAGAG AAGACAATTG
1301  GCAAGTATGC TAAGTCAGAG TTTGACAAAT GACCCTATAA TTCTCAGATC
1351  ACCTATTATA TATTATGCTA GCTATGAAAA AAACTAACAG ATATCATGGA
1401  TAATCTCACA AAAGTTCGTG AGTATCTCAA GTCCTATTCT CGTCTAGATC
1451  AGGCGGTAGG AGAGATAGAT GAGATCGAAG CACAACGAGC TGAAAAGTCC
1501  AATTATGAGT TGTTCCAAGA GGACGGAGTG GAAGAGCATA CTAGGCCCTC
1551  TTATTTTCAG GCAGCAGATG ATTCTGACAC AGAATCTGAA CCAGAAATTG
1601  AAGACAATCA AGGCTTGTAT GTACCAGATC CGGAAGCTGA GCAAGTTGAA
1651  GGCTTTATAC AGGGGCCTTT AGATGACTAT GCAGATGAGG ACGTGGATGT
1701  TGTATTCACT TCGGACTGGA AACAGCCTGA GCTTGAATCC GACGAGCATG
1751  GAAAGACCTT ACGGTTGACA TTGCCAGAGG GTTTAAGTGG AGAGCAGAAA
1801  TCCCAGTGGC TTTTGACGAT TAAAGCAGTC GTTCAAAGTG CCAAACACTG
1851  GAATCTGGCA GAGTGCACAT TTGAAGCATC GGGAGAAGGG GTCATCATAA
1901  AAAAGCGCCA GATAACTCCG GATGTATATA AGGTCACTCC AGTGATGAAC
1951  ACACATCCGT CCCAATCAGA AGCCGTATCA GATGTTTGGT CTCTCTCAAA
2001  GACATCCATG ACTTTCCAAC CCAAGAAAGC AAGTCTTCAG CCTCTCACCA
2051  TATCCTTGGA TGAATTGTTC TCATCTAGAG GAGAATTCAT CTCTGTCGGA
2101  GGTAACGGAC GAATGTCTCA TAAAGAGGCC ATCCTGCTCG GTCTGAGGTA
2151  CAAAAAGTTG TACAATCAGG CGAGAGTCAA ATATTCTCTG TAGACTAGTA
2201  TGAAAAAAG TAACAGATAT CACAATCTAA GTGTTATCCC AATCCATTCA
2251  TCATGAGTTC CTTAAGAAG ATTCTCGGTC TGAAGGGGAA AGGTAAGAAA
2301  TCTAAGAAAT TAGGGATCGC ACCACCCCCT TATGAAGAGG ACACTAACAT
2351  GGAGTATGCT CCGAGCGCTC CAATTGACAA ATCCTATTTT GGAGTTGACG
2401  AGATGGACAC TCATGATCCG AATCAATTAA GATATGAGAA ATTCTTCTTT
2451  ACAGTGAAAA TGACGGTTAG ATCTAATCGT CCGTTCAGAA CATACTCAGA
2501  TGTGGCAGCC GCTGTATCCC ATTGGGATCA CATGTACATC GGAATGGCAG
2551  GGAAACGTCC CTTCTACAAG ATCTTGGCTT TTTTGGGTTC TTCTAATCTA
```

*Fig. 23F*

```
2601  AAGGCCACTC CAGCGGTATT GGCAGATCAA GGTCAACCAG AGTATCATGC
2651  TCACTGTGAA GGCAGGGCTT ATTTGCCACA CAGAATGGGG AAGACCCCTC
2701  CCATGCTCAA TGTACCAGAG CACTTCAGAA GACCATTCAA TATAGGTCTT
2751  TACAAGGGAA CGATTGAGCT CACAATGACC ATCTACGATG ATGAGTCACT
2801  GGAAGCAGCT CCTATGATCT GGGATCATTT CAATTCTTCC AAATTTTCTG
2851  ATTTCAGAGA GAAGGCCTTA ATGTTTGGCC TGATTGTCGA GAAAAAGGCA
2901  TCTGGAGCTT GGGTCCTGGA TTCTGTCAGC CACTTCAAAT GAGCTAGTCT
2951  AGCTTCCAGC TTCTGAACAA TCCCGGTTT ACTCAGTCTC TCCTAATTCC
3001  AGCCTTTCGA ATTAATTAAA TTTTAATTTT TAATTTTTAT GAAAAAAAAC
3051  TAACAGCAAT CATGGAAGTC CACGATTTTG AGACCGACGA GTTCAATGAT
3101  TTCAATGAAG ATGACTATGC CACAAGAGAA TTCCTGAATC CCGATGAGCG
3151  CATGACGTAC TTGAATCATG CTGATTACAA TTTGAATTCT CCTCTAATTA
3201  GTGATGATAT TGACAATTTG ATCAGGAAAT TCAATTCTCT TCCGATTCCC
3251  TCGATGTGGG ATAGTAAGAA CTGGGATGGA GTTCTTGAGA TGTTAACATC
3301  ATGTCAAGCC AATCCCATCT CAACATCTCA GATGCATAAA TGGATGGGAA
3351  GTTGGTTAAT GTCTGATAAT CATGATGCCA GACAAGGGTA TAGTTTTTA
3401  CATGAAGTGG ACAAAGAGGC AGAAATAACA TTTGACGTGG TGGAGACCTT
3451  CATCCGCGGC TGGGGCAACA AACCAATTGA ATACATCAAA AAGGAAAGAT
3501  GGACTGACTC ATTCAAAATT CTCGCTTATT TGTGTCAAAA GTTTTTGGAC
3551  TTACACAAGT TGACATTAAT CTTAAATGCT GTCTCTGAGG TGGAATTGCT
3601  CAACTTGGCG AGGACTTTCA AAGGCAAAGT CAGAAGAAGT CTCATGGAA
3651  CGAACATATG CAGGCTTAGG GTTCCAGCT TGGGTCCTAC TTTTATTTCA
3701  GAAGGATGGG CTTACTTCAA GAAACTTGAT ATTCTAATGG ACCGAAACTT
3751  TCTGTTAATG GTCAAAGATG TGATTATAGG GAGGATGCAA ACGGTGCTAT
3801  CCATGGTATG TAGAATAGAC AACCTGTTCT CAGAGCAAGA CATCTTCTCC
3851  CTTCTAAATA TCTACAGAAT TGGAGATAAA ATTGTGGAGA GGCAGGGAAA
3901  TTTTTCTTAT GACTTGATTA AAATGGTGGA ACCGATATGC AACTTGAAGC
3951  TGATGAAATT AGCAAGAGAA TCAAGGCCTT TAGTCCCACA ATTCCCTCAT
4001  TTTGAAAATC ATATCAAGAC TTCTGTTGAT GAAGGGGCAA AAATTGACCG
4051  AGGTATAAGA TTCCTCCATG ATCAGATAAT GAGTGTGAAA ACAGTGGATC
4101  TCACACTGGT GATTATGGA TCGTTCAGAC ATTGGGGTCA TCCTTTTATA
4151  GATTATTACG CTGGACTAGA AAAATTACAT TCCCAAGTAA CCATGAAGAA
4201  AGATATTGAT GTGTCATATG CAAAAGCACT TGCAAGTGAT TTAGCTCGGA
4251  TTGTTCTATT TCAACAGTTC AATGATCATA AAAAGTGGTT CGTGAATGGA
4301  GACTTGCTCC CTCATGATCA TCCCTTTAAA AGTCATGTTA AGAAAATAC
4351  ATGGCCTACA GCTGCTCAAG TTCAAGATTT TGGAGATAAA TGGCATGAAC
4401  TTCCGCTGAT TAAATGTTTT GAAATACCCG ACTTACTAGA CCCATCGATA
4451  ATATACTCTG ACAAAGTCA TTCAATGAAT AGGTCAGAGG TGTTGAAACA
4501  TGTCCGAATG AATCCGAACA CTCCTATCCC TAGTAAAAAG GTGTTGCAGA
4551  CTATGTTGGA CACAAAGGCT ACCAATTGGA AAGAATTTCT TAAAGAGATT
4601  GATGAGAAGG GCTTAGATGA TGATGATCTA ATTATTGGTC TTAAAGGAAA
4651  GGAGAGGGAA CTGAAGTTGG CAGGTAGATT TTTCTCCCTA ATGTCTTGGA
4701  AATTGCGAGA ATACTTTGTA ATTACCGAAT ATTTGATAAA GACTCATTTC
4751  GTCCCTATGT TTAAAGGCCT GACAATGGCG GACGATCTAA CTGCAGTCAT
4801  TAAAAGATG TTAGATTCCT CATCCGGCCA AGGATTGAAG TCATATGAGG
4851  CAATTTGCAT AGCCAATCAC ATTGATTACG AAAAATGGAA TAACCACCAA
4901  AGGAAGTTAT CAAACGGCCC AGTGTTCCGA GTTATGGGCC AGTTCTTAGG
4951  TTATCCATCC TTAATCGAGA GAACTCATGA ATTTTTTGAG AAAAGTCTTA
5001  TATACTACAA TGGAAGACCA GACTTGATGC GTGTTCACAA CAACACACTG
5051  ATCAATTCAA CCTCCCAACG AGTTTGTTGG CAAGGACAAG AGGGTGGACT
5101  GGAAGGTCTA CGGCAAAAAG GATGGAGTAT CCTCAATCTA CTGGTTATTC
5151  AAAGAGAGGC TAAAATCAGA AACACTGCTG TCAAAGTCTT GGCACAAGGT
```

*Fig. 23F (cont.)*

```
5201  GATAATCAAG TTATTTGCAC ACAGTATAAA ACGAAGAAAT CGAGAAACGT
5251  TGTAGAATTA CAGGGTGCTC TCAATCAAAT GGTTTCTAAT AATGAGAAAA
5301  TTATGACTGC AATCAAAATA GGGACAGGGA AGTTAGGACT TTTGATAAAT
5351  GACGATGAGA CTATGCAATC TGCAGATTAC TTGAATTATG GAAAAATACC
5401  GATTTTCCGT GGAGTGATTA GAGGGTTAGA GACCAAGAGA TGGTCACGAG
5451  TGACTTGTGT CACCAATGAC CAAATACCCA CTTGTGCTAA TATAATGAGC
5501  TCAGTTTCCA CAAATGCTCT CACCGTAGCT CATTTTGCTG AGAACCCAAT
5551  CAATGCCATG ATACAGTACA ATTATTTTGG ACATTTGCT AGACTCTTGT
5601  TGATGATGCA TGATCCTGCT CTTCGTCAAT CATTGTATGA AGTTCAAGAT
5651  AAGATACCGG GCTTGCACAG TTCTACTTTC AAATACGCCA TGTTGTATTT
5701  GGACCCTTCC ATTGGAGGAG TGTCGGGCAT GTCTTTGTCC AGGTTTTTGA
5751  TTAGAGCCTT CCCAGATCCC GTAACAGAAA GTCTCTCATT CTGGAGATTC
5801  ATCCATGTAC ATGCTCGAAG TGAGCATCTG AAGGAGATGA GTGCAGTATT
5851  TGGAAACCCC GAGATAGCCA AGTTCCGAAT AACTCACATA GACAAGCTAG
5901  TAGAAGATCC AACCTCTCTG AACATCGCTA TGGGAATGAG TCCAGCGAAC
5951  TTGTTAAAGA CTGAGGTTAA AAAATGCTTA ATCGAATCAA GACAAACCAT
6001  CAGGAACCAG GTGATTAAGG ATGCAACCAT ATATTTGTAT CATGAAGAGG
6051  ATCGGCTCAG AAGTTTCTTA TGGTCAATAA ATCCTCTGTT CCCTAGATTT
6101  TTAAGTGAAT TCAAATCAGG CACTTTTTTG GGAGTCGCAG ACGGGCTCAT
6151  CAGTCTATTT CAAAATTCTC GTACTATTCG GAACTCCTTT AAGAAAAAGT
6201  ATCATAGGGA ATTGGATGAT TGATTGTGA GGAGTGAGGT ATCCTCTTTG
6251  ACACATTTAG GGAAACTTCA TTTGAGAAGG GGATCATGTA AAATGTGGAC
6301  ATGTTCAGCT ACTCATGCTG ACACATTAAG ATACAAATCC TGGGGCCGTA
6351  CAGTTATTGG GACAACTGTA CCCCATCCAT TAGAAATGTT GGGTCCACAA
6401  CATCGAAAAG AGACTCCTTG TGCACCATGT AACACATCAG GGTTCAATTA
6451  TGTTTCTGTG CATTGTCCAG ACGGGATCCA TGACGTCTTT AGTTCACGGG
6501  GACCATTGCC TGCTTATCTA GGGTCTAAAA CATCTGAATC TACATCTATT
6551  TTGCAGCCTT GGGAAAGGGA AAGCAAAGTC CCACTGATTA AAAGAGCTAC
6601  ACGTCTTAGA GATGCTATCT CTTGGTTTGT TGAACCCGAC TCTAAACTAG
6651  CAATGACTAT ACTTTCTAAC ATCCACTCTT TAACAGGCGA AGAATGGACC
6701  GAAAGGCAGC ATGGGTTCAA AAGAACAGGG TCTGCCCTTC ATAGGTTTTC
6751  GACATCTCGG ATGAGCCATG GTGGGTTCGC ATCTCAGAGC ACTGCAGCAT
6801  TGACCAGGTT GATGGCAACT ACAGACACCA TGAGGGATCT GGGAGATCAG
6851  AATTTCGACT TTTTATTCCA AGCAACGTTG CTCTATGCTC AAATTACCAC
6901  CACTGTTGCA AGAGACGGAT GGATCACCAG TTGTACAGAT CATTATCATA
6951  TTGCCTGTAA GTCCTGTTTG AGACCCATAG AAGAGATCAC CCTGGACTCA
7001  AGTATGGACT ACACGCCCCC AGATGTATCC CATGTGCTGA AGACATGGAG
7051  GAATGGGGAA GGTTCGTGGG ACAAGAGAT AAAACAGATC TATCCTTTAG
7101  AAGGGAATTG GAAGAATTTA GCACCTGCTG AGCAATCCTA TCAAGTCGGC
7151  AGATGTATAG GTTTTCTATA TGGAGACTTG GCGTATAGAA AATCTACTCA
7201  TGCCGAGGAC AGTTCTCTAT TTCCTCTATC TATACAAGGT CGTATTAGAG
7251  GTCGAGGTTT CTTAAAAGGG TTGCTAGACG GATTAATGAG AGCAAGTTGC
7301  TGCCAAGTAA TACACCGGAG AAGTCTGGCT CATTTGAAGA GGCCGGCCAA
7351  CGCAGTGTAC GGAGGTTTGA TTTACTTGAT TGATAAATTG AGTGTATCAC
7401  CTCCATTCCT TTCTCTTACT AGATCAGGAC CTATTAGAGA CGAATTAGAA
7451  ACGATTCCCC ACAAGATCCC AACCTCCTAT CCGACAAGCA ACCGTGATAT
7501  GGGGGTGATT GTCAGAAATT ACTTCAAATA CCAATGCCGT CTAATTGAAA
7551  AGGGAAAATA CAGATCACAT TATTCACAAT TATGGTTATT CTCAGATGTC
7601  TTATCCATAG ACTTCATTGG ACCATTCTCT ATTTCCACCA CCCTCTTGCA
7651  AATCCTATAC AAGCCATTTT TATCTGGGAA AGATAAGAAT GAGTTGAGAG
7701  AGCTGGCAAA TCTTTCTTCA TTGCTAAGAT CAGGAGAGGG GTGGGAAGAC
7751  ATACATGTGA AATTCTTCAC CAAGGACATA TTATTGTGTC CAGAGGAAAT
```

*Fig. 23F (cont.)*

```
7801  CAGACATGCT TGCAAGTTCG GGATTGCTAA GGATAATAAT AAAGACATGA
7851  GCTATCCCCC TTGGGGAAGG GAATCCAGAG GGACAATTAC AACAATCCCT
7901  GTTTATTATA CGACCACCCC TTACCCAAAG ATGCTAGAGA TGCCTCCAAG
7951  AATCCAAAAT CCCCTGCTGT CCGGAATCAG GTTGGGCCAA TTACCAACTG
8001  GCGCTCATTA TAAAATTCGG AGTATATTAC ATGGAATGGG AATCCATTAC
8051  AGGGACTTCT TGAGTTGTGG AGACGGCTCC GGAGGGATGA CTGCTGCATT
8101  ACTACGAGAA AATGTGCATA GCAGAGGAAT ATTCAATAGT CTGTTAGAAT
8151  TATCAGGGTC AGTCATGCGA GGCGCCTCTC CTGAGCCCCC CAGTGCCCTA
8201  GAAACTTTAG GAGGAGATAA ATCGAGATGT GTAAATGGTG AAACATGTTG
8251  GGAATATCCA TCTGACTTAT GTGACCCAAG GACTTGGGAC TATTTCCTCC
8301  GACTCAAAGC AGGCTTGGGG CTTCAAATTG ATTTAATTGT AATGGATATG
8351  GAAGTTCGGG ATTCTTCTAC TAGCCTGAAA ATTGAGACGA ATGTTAGAAA
8401  TTATGTGCAC CGGATTTTGG ATGAGCAAGG AGTTTTAATC TACAAGACTT
8451  ATGGAACATA TATTTGTGAG AGCGAAAAGA ATGCAGTAAC AATCCTTGGT
8501  CCCATGTTCA AGACGGTCGA CTTAGTTCAA ACAGAATTTA GTAGTTCTCA
8551  AACGTCTGAA GTATATATGG TATGTAAAGG TTTGAAGAAA TTAATCGATG
8601  AACCCAATCC CGATTGGTCT TCCATCAATG AATCCTGGAA AAACCTGTAC
8651  GCATTCCAGT CATCAGAACA GGAATTTGCC AGAGCAAAGA AGGTTAGTAC
8701  ATACTTTACC TTGACAGGTA TTCCCTCCCA ATTCATTCCT GATCCTTTTG
8751  TAAACATTGA GACTATGCTA CAAATATTCG GAGTACCCAC GGGTGTGTCT
8801  CATGCGGCTG CCTTAAAATC ATCTGATAGA CCTGCAGATT TATTGACCAT
8851  TAGCCTTTTT TATATGGCGA TTATATCGTA TTATAACATC AATCATATCA
8901  GAGTAGGACC GATACCTCCG AACCCCCCAT CAGATGGAAT TGCACAAAAT
8951  GTGGGGATCG CTATAACTGG TATAAGCTTT TGGCTGAGTT TGATGGAGAA
9001  AGACATTCCA CTATATCAAC AGTGTTTAGC AGTTATCCAG CAATCATTCC
9051  CGATTAGGTG GGAGGCTGTT TCAGTAAAAG GAGGATACAA GCAGAAGTGG
9101  AGTACTAGAG GTGATGGGCT CCCAAAAGAT ACCCGAATTT CAGACTCCTT
9151  GGCCCCAATC GGGAACTGGA TCAGATCTCT GGAATTGGTC CGAAACCAAG
9201  TTCGTCTAAA TCCATTCAAT GAGATCTTGT TCAATCAGCT ATGTCGTACA
9251  GTGGATAATC ATTTGAAATG GTCAAATTTG CGAAAAAACA CAGGAATGAT
9301  TGAATGGATC AATAGACGAA TTTCAAAAGA AGACCGGTCT ATACTGATGT
9351  TGAAGAGTGA CCTACACGAG GAAAACTCTT GGAGAGATTA AAAAATCATG
9401  AGGAGACTCC AAACTTTAAG TATGAAAAAA ACTTTGATCC TTAAGACCCT
9451  CTTGTGGTTT TTATTTTTTA TCTGGTTTTG TGGTCTTCGT
```

*Fig. 23F (cont.)*

VSV-N   VSV-P   VSV-M   SARS-CoV2-S protein-optimized   VSV-L

MB1 Pre-MVS Reference
13440 bp

*Fig. 24A*

VSV-N amino acid sequence of MB1 (SEQ ID NO: 155)

MSVTVKRIIDNTVVVPKLPANEDPVEYPADYFRKSKEIPLYINTTKSLSDLRGYVYQG
LKSGNVSIIHVNSYLYGALKDIRGKLDKDWSSFGINIGKAGDTIGIFDLVSLKALDGV
LPDGVSDASRTSADDKWLPLYLLGLYRVGRTQMPEYRKKLMDGLTNQCKMINEQF
EPLVPEGRDIFDVWGNDSNYTKIVAAVDMFFHMFKKHECASFRYGTIVSRFKDCAA
LATFGHLCKITGMSTEDVTTWILNREVADEMVQMMLPGQEIDKADSYMPYLIDFGL
SSKSPYSSVKNPAFHFWGQLTALLLRSTRARNARQPDDIEYTSLTTAGLLYAYAVGS
SADLAQQFCVGDNKYTPDDSTGGLTTNAPPQGRDVVEWLGWFEDQNRKPTPDMM
QYAKRAVMSLQGLREKTIGKYAKSEFDK*

*Fig. 24B*

VSV-P amino acid sequence of MB1 (SEQ ID NO: 156)

MDNLTKVREYLKSYSRLDQAVGEIDEIEAQRAEKSNYELFQEDGVEEHTKPSYFQAA
DDSDTESEPEIEDNQGLYAPDPEAEQVEGFIQGPLDDYADEEVDVVFTSDWKQPELE
SDEHGKTLRLTSPEGLSGEQKSQWLSTIKAVVQSAKYWNLAECTFEASGEGVIMKER
QITPDVYKVTPVMNTHPSQSEAVSDVWSLSKTSMTFQPKKASLQPLTISLDELFSSRG
EFISVGGDGRMSHKEAILLGLRYKKLYNQARVKYSL*

*Fig. 24C*

VSV-M amino acid sequence (with a Y61S mutation) of MB1 (SEQ ID NO: 151)

MSSLKKILGLKGKGKKSKKLGIAPPPYEEDTSMEYAPSAPIDKSYFGVDEMDTYDPN
QLRSEKFFFTVKMTVRSNRPFRTYSDVAAAVSHWDHMYIGMAGKRPFYKILAFLGS
SNLKATPAVLADQGQPEYHAHCEGRAYLPHRMGKTPPMLNVPEHFRRPFNIGLYKG
TIELTMTIYDDESLEAAPMIWDHFNSSKFSDFREKALMFGLIVEKKASGAWVLDSIGH
FK*

*Fig. 24D*

SARS-CoV-2 S protein sequence (with R683G, S813F, and G1251* mutations)
of MB1 (SEQ ID NO: 153)

MFVFLVLLPLVSSQCVNLTTRTQLPPAYTNSFTRGVYYPDKVFRSSVLHSTQDLFLPF
FSNVTWFHAIHVSGTNGTKRFDNPVLPFNDGVYFASTEKSNIIRGWIFGTTLDSKTQS
LLIVNNATNVVIKVCEFQFCNDPFLGVYYHKNNKSWMESEFRVYSSANNCTFEYVS
QPFLMDLEGKQGNFKNLREFVFKNIDGYFKIYSKHTPINLVRDLPQGFSALEPLVDLP
IGINITRFQTLLALHRSYLTPGDSSSGWTAGAAAYYVGYLQPRTFLLKYNENGTITDA
VDCALDPLSETKCTLKSFTVEKGIYQTSNFRVQPTESIVRFPNITNLCPFGEVFNATRF
ASVYAWNRKRISNCVADYSVLYNSASFSTFKCYGVSPTKLNDLCFTNVYADSFVIRG
DEVRQIAPGQTGKIADYNYKLPDDFTGCVIAWNSNNLDSKVGGNYNYLYRLFRKSN
LKPFERDISTEIYQAGSTPCNGVEGFNCYFPLQSYGFQPTNGVGYQPYRVVVLSFELL
HAPATVCGPKKSTNLVKNKCVNFNFNGLTGTGVLTESNKKFLPFQQFGRDIADTTD
AVRDPQTLEILDITPCSFGGVSVITPGTNTSNQVAVLYQDVNCTEVPVAIHADQLTPT
WRVYSTGSNVFQTRAGCLIGAEHVNNSYECDIPIGAGICASYQTQTNSPRGARSVAS
QSIIAYTMSLGAENSVAYSNNSIAIPTNFTISVTTEILPVSMTKTSVDCTMYICGDSTEC
SNLLLQYGSFCTQLNRALTGIAVEQDKNTQEVFAQVKQIYKTPPIKDFGGFNFSQILP
DPSKPFKRSFIEDLLFNKVTLADAGFIKQYGDCLGDIAARDLICAQKFNGLTVLPPLLT
DEMIAQYTSALLAGTITSGWTFGAGAALQIPFAMQMAYRFNGIGVTQNVLYENQKLI
ANQFNSAIGKIQDSLSSTASALGKLQDVVNQNAQALNTLVKQLSSNFGAISSVLNDIL
SRLDKVEAEVQIDRLITGRLQSLQTYVTQQLIRAAEIRASANLAATKMSECVLGQSKR
VDFCGKGYHLMSFPQSAPHGVVFLHVTYVPAQEKNFTTAPAICHDGKAHFPREGVF
VSNGTHWFVTQRNFYEPQIITTDNTFVSGNCDVVIGIVNNTVYDPLQPELDSFKEELD
KYFKNHTSPDVDLGDISGINASVVNIQKEIDRLNEVAKNLNESLIDLQELGKYEQYIK
WPWYIWLGFIAGLIAIVMVTIMLCCMTSCCSCLKGCCSC*

*Fig. 24E*

VSV-L amino acid sequence of MB1 (SEQ ID NO: 152)

MEVHDFETDEFNDFNEDDYATREFLNPDERMTYLNHADYNLNSPLISDDIDNLIRKF
NSLPIPSMWDSKNWDGVLEMLTSCQANPIPTSQMHKWMGSWLMSDNHDASQGYSF
LHEVDKEAEITFDVVETFIRGWGNKPIEYIKKERWTDSFKILAYLCQKFLDLHKLTLIL
NAVSEVELLNLARTFKGKVRRSSHGTNICRIRVPSLGPTFISEGWAYFKKLDILMDRN
FLLMVKDVIIGRMQTVLSMVCRIDNLFSEQDIFSLLNIYRIGDKIVERQGNFSYDLIKM
VEPICNLKLMKLARESRPLVPQFPHFENHIKTSVDEGAKIDRGIRFLHDQIMSVKTVD
LTLVIYGSFRHWGHPFIDYYTGLEKLHSQVTMKKDIDVSYAKALASDLARIVLFQQF
NDHKKWFVNGDLLPHDHPFKSHVKENTWPTAAQVQDFGDKWHELPLIKCFEIPDLL
DPSIIYSDKSHSMNRSEVLKHVRMNPNTPIPSKKVLQTMLDTKATNWKEFLKEIDEK
GLDDDDLIIGLKGKERELKLAGRFFSLMSWKLREYFVITEYLIKTHFVPMFKGLTMA
DDLTAVIKKMLDSSSGQGLKSYEAICIANHIDYEKWNNHQRKLSNGPVFRVMGQFL
GYPSLIERTHEFFEKSLIYYNGRPDLMRVHNNTLINSTSQRVCWQGQEGGLEGLRQK
GWSILNLLVIQREAKIRNTAVKVLAQGDNQVICTQYKTKKSRNVVELQGALNQMVS
NNEKIMTAIKIGTGKLGLLINDDETMQSADYLNYGKIPIFRGVIRGLETKRWSRVTCV
TNDQIPTCANIMSSVSTNALTVAHFAENPINAMIQYNYFGTFARLLLMMHDPALRQS
LYEVQDKIPGLHSSTFKYAMLYLDPSIGGVSGMSLSRFLIRAFPDPVTESLSFWRFIHV
HARSEHLKEMSAVFGNPEIAKFRITHIDKLVEDPTSLNIAMGMSPANLLKTEVKKCLI
ESRQTIRNQVIKDATIYLYHEEDRLRSFLWSINPLFPRFLSEFKSGTFLGVADGLISLFQ
NSRTIRNSFKKKYHRELDDLIVRSEVSSLTHLGKLHLRRGSCKMWTCSATHADTLRY
KSWGRTVIGTTVPHPLEMLGPQHRKETPCAPCNTSGFNYVSVHCPDGIHDVFSSRGP
LPAYLGSKTSESTSILQPWERESKVPLIKRATRLRDAISWFVEPDSKLAMTILSNIHSLT
GEEWTKRQHGFKRTGSALHRFSTSRMSHGGFASQSTAALTRLMATTDTMRDLGDQ
NFDFLFQATLLYAQITTTVARDGWITSCTDHYHIACKSCLRPIEEITLDSSMDYTPPDV
SHVLKTWRNGEGSWGQEIKQIYPLEGNWKNLAPAEQSYQVGRCIGFLYGDLAYRKS
THAEDSSLFPLSIQGRIRGRGFLKGLLDGLMRASCCQVIHRRSLAHLKRPANAVYGG
LIYLIDKLSVSPPFLSLTRSGPIRDELETIPHKIPTSYPTSNRDMGVIVRNYFKYQCRLIE
KGKYRSHYSQLWLFSDVLSIDFIGPFSISTTLLQILYKPFLSGKDKNELRELANLSSLLR
SGEGWEDIHVKFFTKDILLCPEEIRHACKFGIAKDNNKDMSYPPWGRESRGTITTIPV
YYTTTPYPKMLEMPPRIQNPLLSGIRLGQLPTGAHYKIRSILHGMGIHYRDFLSCGDG
SGGMTAALLRENVHSRGIFNSLLELSGSVMRGASPEPPSALETLGGDKSRCVNGETC
WEYPSDLCDPRTWDYFLRLKAGLGLQIDLIVMDMEVRDSSTSLKIETNVRNYVHRIL
DEQGVLIYKTYGTYICESEKNAVTILGPMFKTVDLVQTEFSSSQTSEVYMVCKGLKK
LIDEPNPDWSSINESWKNLYAFQSSEQEFARAKKVSTYFTLTGIPSQFIPDPFVNIETM
LQIFGVPTGVSHAAALKSSDRPADLLTISLFYMAIISYYNINHIRVGPIPPNPPSDGIAQ
NVGIAITGISFWLSLMEKDIPLYQQCLAVIQQSFPIRWEAVSVKGGYKQKWSTRGDG
LPKDTRISDSLAPIGNWIRSLELVRNQVRLNPFNEILFNQLCRTVDNHLKWSNLRRNT
GMIEWINRRISKEDRSILMLKSDLHEENSWRD*

*Fig. 24F*

Nucleotide sequence of VSVΔG-SARS-CoV-2 clone MB1 (SEQ ID NO: 150) and the translated proteins represented by the amino acid sequences in FIGS. 24B-F (SEQ ID NOS: 155, 156, 151, 153, and 152, respectively).

```
   1 ACGAAGACAA ACAAACCATT ATTATCATTA AAAGGCTCAG GAGAAACTTT
                   M  S  V  T  V  K  R  I  I  D  N  T  V ·
  51 AACAGTAATC AAAATGTCTG TTACAGTCAA GAGAATCATT GACAACACAG
      · V  V  P  K  L  P  A  N  E  D  P  V  E  Y  P  A
 101 TCGTAGTTCC AAAACTTCCT GCAAATGAGG ATCCAGTGGA ATACCCGGCA
         D  Y  F  R  K  S  K  E  I  P  L  Y  I  N  T  T  K ·
 151 GATTACTTCA GAAAATCAAA GGAGATTCCT CTTTACATCA ATACTACAAA
      · S  L  S  D  L  R  G  Y  V  Y  Q  G  L  K  S  G  N ·
 201 AAGTTTGTCA GATCTAAGAG GATATGTCTA CCAAGGCCTC AAATCCGGAA
      · V  S  I  I  H  V  N  S  Y  L  Y  G  A  L  K  D
 251 ATGTATCAAT CATACATGTC AACAGCTACT TGTATGGAGC ATTAAAGGAC
         I  R  G  K  L  D  K  D  W  S  F  G  I  N  I  G ·
 301 ATCCGGGGTA AGTTGGATAA AGATTGGTCA AGTTTCGGAA TAAACATCGG
      · K  A  G  D  T  I  G  I  F  D  L  V  S  L  K  A  L ·
 351 GAAAGCAGGG GATACAATCG GAATATTTGA CCTTGTATCC TTGAAAGCCC
      · D  G  V  L  P  D  G  V  S  D  A  S  R  T  S  A
 401 TGGACGGCGT ACTTCCAGAT GGAGTATCGG ATGCTTCCAG AACCAGCGCA
         D  D  K  W  L  P  L  Y  L  L  G  L  Y  R  V  G  R ·
 451 GATGACAAAT GGTTGCCTTT GTATCTACTT GGCTTATACA GAGTGGGCAG
      · T  Q  M  P  E  Y  R  K  K  L  M  D  G  L  T  N  Q ·
 501 AACACAAATG CCTGAATACA GAAAAAAGCT CATGGATGGG CTGACAAATC
      · C  K  M  I  N  E  Q  F  E  P  L  V  P  E  G  R
 551 AATGCAAAAT GATCAATGAA CAGTTTGAAC CTCTTGTGCC AGAAGGTCGT
         D  I  F  D  V  W  G  N  D  S  N  Y  T  K  I  V  A ·
 601 GACATTTTTG ATGTGTGGGG AAATGACAGT AATTACACAA AAATTGTCGC
      · A  V  D  M  F  F  H  M  F  K  K  H  E  C  A  S  F ·
 651 TGCAGTGGAC ATGTTCTTCC ACATGTTCAA AAAACATGAA TGTGCCTCGT
      · R  Y  G  T  I  V  S  R  F  K  D  C  A  A  L  A
 701 TCAGATACGG AACTATTGTT TCCAGATTCA AGATTGTGC TGCATTGGCA
         T  F  G  H  L  C  K  I  T  G  M  S  T  E  D  V  T ·
 751 ACATTTGGAC ACCTCTGCAA AATAACCGGA ATGTCTACAG AAGATGTAAC
      · T  W  I  L  N  R  E  V  A  D  E  M  V  Q  M  M  L ·
 801 GACCTGGATC TTGAACCGAG AAGTTGCAGA TGAAATGGTC CAAATGATGC
      · P  G  Q  E  I  D  K  A  D  S  Y  M  P  Y  L  I
 851 TTCCAGGCCA AGAAATTGAC AAGGCCGATT CATACATGCC TTATTTGATC
         D  F  G  L  S  S  K  S  P  Y  S  S  V  K  N  P  A ·
 901 GACTTTGGAT TGTCTTCTAA GTCTCCATAT TCTTCCGTCA AAAACCCTGC
      · F  H  F  W  G  Q  L  T  A  L  L  R  S  T  R  A ·
 951 CTTCCACTTC TGGGGGCAAT TGACAGCTCT TCTGCTCAGA TCCACCAGAG
      · R  N  A  R  Q  P  D  D  I  E  Y  T  S  L  T  T
1001 CAAGGAATGC CCGACAGCCT GATGACATTG AGTATACATC TCTTACTACA
         A  G  L  L  Y  A  Y  A  V  G  S  S  A  D  L  A  Q ·
1051 GCAGGTTTGT TGTACGCTTA TGCAGTAGGA TCCTCTGCCG ACTTGGCACA
      · Q  F  C  V  G  D  N  K  Y  T  P  D  D  S  T  G  G ·
1101 ACAGTTTTGT GTTGGAGATA ACAAATACAC TCCAGATGAT AGTACCGGAG
      · L  T  T  N  A  P  P  Q  G  R  D  V  V  E  W  L
1151 GATTGACGAC TAATGCACCG CCACAAGGCA GAGATGTGGT CGAATGGCTC
         G  W  F  E  D  Q  N  R  K  P  T  P  D  M  Q  Y ·
```

Fig. 24G

```
1201 GGATGGTTTG AAGATCAAAA CAGAAAACCG ACTCCTGATA TGATGCAGTA
      · A  K  R   A  V  M   S  L  Q   G  L  R  E  K  T  I  G ·
1251 TGCGAAAAGA GCAGTCATGT CACTGCAAGG CCTAAGAGAG AAGACAATTG
      · K  Y  A  K  S  E   F  D  K  *
1301 GCAAGTATGC TAAGTCAGAA TTTGACAAAT GACCCTATAA TTCTCAGATC
                                                     M  D ·
1351 ACCTATTATA TATTATGCTA CATATGAAAA AAACTAACAG ATATCATGGA
     · N  L  T   K  V  R  E  Y  L  K   S  Y  S  R  L  D  Q ·
1401 TAATCTCACA AAAGTTCGTG AGTATCTCAA GTCCTATTCT CGTCTGGATC
     · A  V  G   E  I  D   E  I  E  A   Q  R  A  E  K  S
1451 AGGCGGTAGG AGAGATAGAT GAGATCGAAG CACAACGAGC TGAAAAGTCC
      N  Y  E  L  F  Q   E  D  G  V   E  E  H   T  K  P  S ·
1501 AATTATGAGT TGTTCCAAGA GGATGGAGTG GAAGAGCATA CTAAGCCCTC
     · Y  F  Q   A  A  D  D  S  D  T   E  S  E   P  E  I  E ·
1551 TTATTTTCAG GCAGCAGATG ATTCTGACAC AGAATCTGAA CCAGAAATTG
     · D  N  Q   G  L  Y  A  P  D  P  E  A  E   Q  V  E
1601 AAGACAATCA AGGCTTGTAT GCACCAGATC CAGAAGCTGA GCAAGTTGAA
       G  F  I  Q  G  P  L  D  D  Y  A  D  E  E   V  D  V ·
1651 GGCTTTATAC AGGGGCCTTT AGATGACTAT GCAGATGAGG AAGTGGATGT
     · V  F  T   S  D  W  K  Q  P  E   L  E  S  D  E  H  G ·
1701 TGTATTTACT TCGGACTGGA AACAGCCTGA GCTTGAATCT GACGAGCATG
      · K  T  L  R  L  T   S  P  E  G  L  S  G   E  Q  K
1751 GAAAGACCTT ACGGTTGACA TCGCCAGAGG GTTTAAGTGG AGAGCAGAAA
       S  Q  W  L  S  T   I  K  A  V   Q  S  A   K  Y  W ·
1801 TCCCAGTGGC TTTCGACGAT TAAAGCAGTC GTGCAAAGTG CCAAATACTG
     · N  L  A   E  C  T  F  E  A  S   G  E  G  V  I  M  K ·
1851 GAATCTGGCA GAGTGCACAT TTGAAGCATC GGGAGAAGGG GTCATTATGA
     · E  R  Q   I  T  P   D  V  Y  K   V  T  P   V  M  N
1901 AGGAGCGCCA GATAACTCCG GATGTATATA AGGTCACTCC AGTGATGAAC
       T  H  P  S  Q  S  E  A  V  S  D  V  W  S  L  S  K ·
1951 ACACATCCGT CCCAATCAGA AGCAGTATCA GATGTTTGGT CTCTCTCAAA
     · T  S  M  T  F  Q  P  K  K  A   S  L  Q   P  L  T  I ·
2001 GACATCCATG ACTTTCCAAC CCAAGAAAGC AAGTCTTCAG CCTCTCACCA
     · S  L  D   E  L  F  S  S  R  G  E  F  I   S  V  G
2051 TATCCTTGGA TGAATTGTTC TCATCTAGAG GAGAGTTCAT CTCTGTCGGA
       G  D  G  R  M  S  H  K  E  A  I  L  L  G  L  R  Y ·
2101 GGTGACGGAC GAATGTCTCA TAAAGAGGCC ATCCTGCTCG GCCTGAGATA
      · K  K  L   Y  N  Q  A  R  V  K   Y  S  L  *
2151 CAAAAAGTTG TACAATCAGG CGAGAGTCAA ATATTCTCTG TAGACTATGA
                                                         M ·
2201 AAAAAAGTAA CAGATATCAC GATCTAAGTG TTATCCCAAT CCATTCATCA
      · S  S  L  K  K  I   L  G  L  K   G  K  G   K  K  S
2251 TGAGTTCCTT AAAGAAGATT CTCGGTCTGA AGGGGAAAGG TAAGAAATCT
       K  K  L  G  I  A  P   P  P  Y  E  E  D  T   S  M  E ·
2301 AAGAAATTAG GGATCGCACC ACCCCCTTAT GAAGAGGACA CTAGCATGGA
     · Y  A  P   S  A  P  I  D  K  S   Y  F  G  V  D  E  M ·
2351 GTATGCTCCG AGCGCTCCAA TTGACAAATC CTATTTTGGA GTTGACGAGA
     · D  T  Y   D  P  N  Q  L  R  ■   E  K  F  F  F  T
2401 TGGACACCTA TGATCCGAAT CAATTAAGAT ■TGAGAAATT CTTCTTTACA
       V  K  M  T  V  R  S   N  R  P   F  R  T  Y   S  D  V ·
2451 GTGAAAATGA CGGTTAGATC TAATCGTCCG TTCAGAACAT ACTCAGATGT
     · A  A  A   V  S  H  W  D  H  M   Y  I  G   M  A  G  K ·
2501 GGCAGCCGCT GTATCCCATT GGGATCACAT GTACATCGGA ATGGCAGGGA
      · R  P  F  Y  K  I   L  A  F  L   G  S  S   N  L  K
2551 AACGTCCCTT CTACAAAATC TTGGCTTTTT TGGGTTCTTC TAATCTAAAG
       A  T  P  A  V  L  A   D  Q  G   Q  P  E  Y   H  A  H ·
2601 GCCACTCCAG CGGTATTGGC AGATCAAGGT CAACCAGAGT ATCACGCTCA
     · C  E  G   R  A  Y  L  P  H  R   M  G  K   T  P  P  M ·
2651 CTGCGAAGGC AGGGCTTATT TGCCACATAG GATGGGGAAG ACCCCTCCCA
      · L  N  V  P  E  H   F  R  R  P   F  N  I   G  L  Y
2701 TGCTCAATGT ACCAGAGCAC TTCAGAAGAC CATTCAATAT AGGTCTTTAC
       K  G  T  I  E  L  T   M  T  I  Y  D  D  E   S  L  E ·
```

*Fig. 24G (cont.)*

```
2751 AAGGGAACGA TTGAGCTCAC AATGACCATC TACGATGATG AGTCACTGGA
      · A  A  P  M  I  W  D  H  F  N  S  S  K  F  S  D  F ·
2801 AGCAGCTCCT ATGATCTGGG ATCATTTCAA TTCTTCCAAA TTTTCTGATT
      · R  E  K  A  L  M  F  G  L  I  V  E  K  K  A  S
2851 TCAGAGAGAA GGCCTTAATG TTTGGCCTGA TTGTCGAGAA AAAGGCATCT
        G  A  W  V  L  D  S  I  G  H  F  K  *
2901 GGAGCGTGGG TCCTGGACTC TATCGGCCAC TTCAAATGAG CTAGTCTAAC
2951 TTCTAGCTTC TGAACAATCC CCGGTTTACT CAGTCTCCCC TAATTCCAGC
3001 CTCTCGAACA ACTAATATCC TGTCTTTTCT ATCCCTATGA AAAAAACTAA
3051 CAGAGAT GA TCTGTTTACG CGCTAGTGGA TCCTACTCGA GAGGAGCCAC
         M  F  V  F  L  V  L  L  P  L  V  S  S  Q  C  V  N ·
3101 CATGTTCGTG TTCCTGGTGC TATTACCTCT GGTTTCGTCT CAATGCGTAA
      · L  T  T  R  T  Q  L  P  P  A  Y  T  N  S  F  T
3151 ACCTTACAAC TAGAACTCAG CTTCCTCCAG CATACACAAA TTCCTTCACT
        R  G  V  Y  Y  P  D  K  V  F  R  S  S  V  L  H  S ·
3201 CGCGGAGTGT ATTATCCTGA TAAGGTCTTT CGATCATCAG TGTTGCATTC
      · T  Q  D  L  F  L  P  F  F  S  N  V  T  W  F  H  A ·
3251 CACCCAGGAT TTGTTTCTCC CGTTCTTTTC AAATGTAACT TGGTTCCATG
      · I  H  V  S  G  T  N  G  T  K  R  F  D  N  P  V
3301 CTATACATGT TTCCGGAACC AATGGAACAA AGAGATTTGA TAACCCAGTG
        L  P  F  N  D  G  V  Y  F  A  S  T  E  K  S  N  I ·
3351 TTACCATTTA ACGACGGAGT TTATTTCGCA TCAACTGAGA AATCCAATAT
      · I  R  G  W  I  F  G  T  T  L  D  S  K  T  Q  S  L ·
3401 CATTAGAGGC TGGATTTTCG GAACGACCCT GGATTCTAAA ACGCAATCCT
      · L  I  V  N  N  A  T  N  V  V  I  K  V  C  E  F
3451 TGCTGATTGT TAATAATGCA ACAAATGTGG TCATTAAAGT CTGTGAATTC
        Q  F  C  N  D  P  F  L  G  V  Y  Y  H  K  N  N  K ·
3501 CAATTTTGCA ATGATCCATT TCTCGGCGTC TATTACCACA AGAATAACAA
      · S  W  M  E  S  E  F  R  V  Y  S  S  A  N  N  C  T ·
3551 ATCTTGGATG GAGTCAGAGT TCAGGGTTTA TAGTTCCGCA AATAATTGTA
      · F  E  Y  V  S  Q  P  F  L  M  D  L  E  G  K  Q
3601 CTTTTGAATA CGTTTCCCAA CCATTCTTAA TGGACTTGGA GGGAAAACAG
        G  N  F  K  N  L  R  E  F  V  F  K  N  I  D  G  Y ·
3651 GGAAATTTTA AGAATCTAAG AGAATTCGTC TTTAAGAATA TTGATGGATA
      · F  K  I  Y  S  K  H  T  P  I  N  L  V  R  D  L  P ·
3701 TTTCAAGATC TATTCAAAAC ATACACCTAT AAACCTAGTT AGAGATCTCC
      · Q  G  F  S  A  L  E  P  L  V  D  L  P  I  G  I
3751 CGCAAGGGTT TTCAGCCCTA GAGCCACTAG TTGACCTGCC AATTGGGATC
        N  I  T  R  F  Q  T  L  L  A  L  H  R  S  Y  L  T ·
3801 AACATTACTA GATTCCAGAC CCTACTCGCT CTGCATCGGT CATATTTGAC
      · P  G  D  S  S  S  G  W  T  A  G  A  A  A  Y  Y  V ·
3851 ACCAGGAGAT TCATCGTCAG GATGGACCGC TGGAGCAGCT GCTTACTATG
      · G  Y  L  Q  P  R  T  F  L  L  K  Y  N  E  N  G
3901 TTGGGTATCT GCAACCTAGA ACATTTCTCC TAAAGTATAA TGAAAACGGG
        T  I  T  D  A  V  D  C  A  L  D  P  L  S  E  T  K ·
3951 ACTATTACAG ACGCAGTCGA TTGCGCACTG GATCCACTCT CAGAGACAAA
      · C  T  L  K  S  F  T  V  E  K  G  I  Y  Q  T  S  N ·
4001 GTGCACTCTA AAATCATTCA CTGTCGAGAA AGGAATCTAT CAAACATCAA
      · F  R  V  Q  P  T  E  S  I  V  R  F  P  N  I  T
4051 ATTTCAGGGT CCAGCCAACT GAGAGTATTG TCCGGTTCCC TAACATAACT
        N  L  C  P  F  G  E  V  F  N  A  T  R  F  A  S  V ·
4101 AACTTGTGCC CCTTCGGAGA GGTTTTCAAT GCTACTCGGT TCGCCAGCGT
      · Y  A  W  N  R  K  R  I  S  N  C  V  A  D  Y  S  V ·
4151 CTACGCATGG AACAGAAAGA GGATTTCAAA CTGTGTCGCA GATTATAGCG
      · L  Y  N  S  A  S  F  S  T  F  K  C  Y  G  V  S
4201 TCCTCTATAA TTCAGCATCA TTCAGTACAT TTAAATGCTA TGGTGTCAGC
        P  T  K  L  N  D  L  C  F  T  N  V  Y  A  D  S  F ·
4251 CCCACCAAAC TTAATGACTT ATGTTTTACC AATGTATATG CAGATTCCTT
      · V  I  R  G  D  E  V  R  Q  I  A  P  G  Q  T  G  K ·
4301 TGTAATCAGA GGTGACGAAG TGAGGCAAAT CGCACCTGGA CAGACCGGAA
      · I  A  D  Y  N  Y  K  L  P  D  D  F  T  G  C  V
4351 AGATTGCTGA TTATAATTAT AAACTCCCTG ATGATTTTAC CGGATGTGTT
```

*Fig. 24G (cont.)*

```
                I  A  W  N    S  N  N    L  D  S    K  V  G    G  N  Y  N  ·
4401 ATTGCTTGGA ACAGCAATAA CCTCGATAGT AAGGTCGGAG GAAACTATAA
     ·Y  L  Y    R  L  F    R  K  S    N  L  K  P    F  E  R  D  ·
4451 CTATTTGTAC AGACTGTTTA GAAAGTCGAA TTTGAAACCT TTTGAAAGAG
     ·I  S  T    E  I  Y    Q  A  G  S    T  P  C    N  G  V
4501 ACATATCCAC CGAGATTTAC CAGGCGGGCA GCACACCGTG TAATGGTGTA
         E  G  F  N    C  Y  F    P  L  Q    S  Y  G    F  Q  P  T  ·
4551 GAAGGATTCA ATTGTTACTT TCCCCTGCAA TCATATGGGT TTCAACCAAC
     ·N  G  V    G  Y  Q  P    Y  R  V    V  V  L    S  F  E  L  ·
4601 CAATGGAGTC GGATATCAAC CATATCGTGT CGTCGTCCTT TCCTTCGAGC
      ·L  H  A  P  A  T    V  C  G  P    K  K  S    T  N  L
4651 TGCTTCATGC ACCAGCTACA GTCTGCGGAC CTAAGAAGAG CACTAATCTT
         V  K  N  K    C  V  N    F  N  F    N  G  L    T  G  T  G  ·
4701 GTCAAGAACA AATGTGTGAA CTTTAATTTT AATGGATTAA CAGGAACCGG
     ·V  L  T    E  S  N  K    K  F  L    P  F  Q    Q  F  G  R  ·
4751 AGTTTTGACC GAGAGTAATA AGAAGTTCTT GCCGTTCCAG CAATTTGGAC
     ·D  I  A    D  T  T    D  A  V  R    D  P  Q    T  L  E
4801 GAGACATTGC TGACACCACA GATGCGGTTC GTGACCCGCA AACTTTAGAG
         I  L  D  I    T  P  C    S  F  G    G  V  S    I  T  P  ·
4851 ATCCTAGACA TCACCCCATG TTCATTCGGT GGAGTTTCCG TTATTACTCC
     ·G  T  N    T  S  N  Q    V  A  V    L  Y  Q    D  V  N  C  ·
4901 TGGAACGAAT ACAAGCAATC AAGTTGCCGT TCTCTATCAA GATGTTAATT
     ·T  E  V    P  V  A    I  H  A  D    Q  L  T    P  T  W
4951 GTACAGAAGT GCCTGTGGCC ATTCATGCAG ATCAACTAAC ACCAACTTGG
         R  V  Y  S    T  G  S    N  V  F    Q  T  R    A  G  C  L  ·
5001 AGAGTTTACA GCACTGGGTC CAATGTCTTC CAAACGCGCG CCGGCTGCCT
     ·I  G  A    E  H  V  N    N  S  Y    E  C  D    I  P  I  G  ·
5051 CATTGGTGCA GAACATGTGA ATAACTCATA CGAATGTGAC ATTCCAATCG
      ·A  G  I    C  A  S    Y  Q  T  Q    T  N  S    P  R
5101 GTGCCGGCAT ATGCGCCTCT TACCAGACTC AGACTAATTC GCCAAGA GA
         A  R  S    V  A  S  Q    S  I  I    A  Y  T    M  S  L  G  ·
5151 GCCAGGTCTG TCGCAAGTCA GTCAATTATT GCATACACAA TGTCGTTAGG
     ·A  E  N    S  V  A  Y    S  N  N    S  I  A    I  P  T  N  ·
5201 AGCAGAGAAT AGTGTAGCAT ACTCAAACAA TTCTATAGCA ATACCTACCA
      ·F  T  I    S  V  T    T  E  I  L    P  V  S    M  T  K
5251 ACTTCACTAT ATCAGTAACT ACAGAAATAT TGCCAGTATC CATGACTAAA
         T  S  V  D    C  T  M    Y  I  C    G  D  S    T  E  C  S  ·
5301 ACAAGTGTGG ATTGCACCAT GTACATCTGT GGAGATTCCA CAGAATGCAG
     ·N  L  L    L  Q  Y  G    S  F  C    T  Q  L    N  R  A  L  ·
5351 CAATCTTCTC TTGCAATACG GATCATTCTG CACACAACTG AATAGGGCAC
      ·T  G  I    A  V  E    Q  D  K  N    T  Q  E    V  F  A
5401 TGACTGGAAT TGCAGTCGAA CAGGATAAGA ACACACAGGA GGTGTTTGCC
         Q  V  K  Q    I  Y  K    T  P  P    I  K  D    F  G  G  F  ·
5451 CAAGTCAAAC AAATATACAA AACACCACCC ATCAAGGATT TTGGAGGATT
     ·N  F  S    Q  I  L    P  D  P  S    K  P       K  R  S  F  ·
5501 TAATTTCTCA CAAATACTCC CCGACCCATC CAAGCCCT C AAAAGGAGTT
     ·I  E  D    L  L  F    N  K  V  T    L  A  D    A  G  F
5551 TCATTGAGGA CCTCTTGTTT AATAAGGTTA CCTTGGCAGA TGCCGGGTTT
         I  K  Q  Y    G  D  C    L  G  D    I  A  A  R    D  L  I  ·
5601 ATTAAGCAGT ACGGCGACTG TCTTGGAGAC ATAGCAGCCA GAGATCTAAT
     ·C  A  Q    K  F  N  G    L  T  V    L  P  P    L  L  T  D  ·
5651 TTGTGCCCAG AAATTCAATG GACTGACAGT CCTGCCTCCC TTATTAACTG
      ·E  M  I    A  Q  Y    T  S  A  L    L  A  G    T  I  T
5701 ATGAGATGAT AGCTCAGTAT ACATCAGCAT TGTTGGCTGG TACAATTACA
         S  G  W  T    F  G  A    G  A  A    L  Q  I  P    F  A  M  ·
5751 TCTGGATGGA CATTTGGTGC CGGAGCGGCA TTACAAATCC CTTTTGCAAT
     ·Q  M  A    Y  R  F    N  G  I  G    V  T  Q    N  V  L  Y  ·
5801 GCAAATGGCC TATAGATTTA ATGGAATCGG AGTAACTCAA AATGTTTTAT
      ·E  N  Q    K  L  I    A  N  Q  F    N  S  A    I  G  K
5851 ATGAGAATCA GAAATTAATT GCAAATCAAT TCAATTCAGC TATAGGAAAG
         I  Q  D    S  L  S  S    T  A  S    A  L  G  K    L  Q  D  ·
5901 ATTCAGGATT CACTCAGTAG TACAGCAAGC GCTCTAGGCA AATTACAAGA
```

*Fig. 24G (cont.)*

```
                · V   V   N   Q   N   A   Q   A   L   N   T   L   V   K   Q   L   S ·
     5951 CGTCGTCAAT CAGAATGCAC AGGCATTAAA TACACTGGTG AAGCAATTGA
            · S   N   F   G   A   I   S   S   V   L   N   D   I   L   S   R
     6001 GTTCCAATTT CGGAGCAATT TCATCTGTTC TAAATGATAT ATTGTCAAGA
               L   D   K   V   E   A   E   V   Q   I   D   R   L   I   T   G   R ·
     6051 CTGGATAAAG TAGAAGCCGA GGTCCAAATC GATAGGCTGA TCACAGGAAG
          · L   Q   S   L   Q   T   Y   V   T   Q   Q   L   I   R   A   A   E ·
     6101 ACTTCAATCA CTACAGACAT ACGTCACCCA ACAACTCATC AGAGCAGCAG
             · I   R   A   S   A   N   L   A   A   T   K   M   S   E   C   V
     6151 AAATTAGAGC CTCTGCTAAT CTAGCCGCAA CAAAGATGTC AGAGTGCGTA
               L   G   Q   S   K   R   V   D   F   C   G   K   G   Y   H   L   M ·
     6201 TTGGGACAAT CTAAGAGGGT CGACTTTTGT GGAAAGGGGT ATCACTTGAT
          · S   F   P   Q   S   A   P   H   G   V   V   F   L   H   V   T   Y ·
     6251 GTCCTTTCCT CAATCTGCAC CACACGGAGT TGTCTTCTTA CATGTAACAT
            · V   P   A   Q   E   K   N   F   T   T   A   P   A   I   C   H
     6301 ATGTGCCCGC TCAAGAAAAG AATTTCACTA CAGCACCTGC AATATGTCAT
               D   G   K   A   H   F   P   R   E   G   V   F   V   S   N   G   T ·
     6351 GACGGAAAAG CACATTTTCC TCGGGAGGGA GTTTTCGTTT CTAATGGAAC
            · H   W   F   V   T   Q   R   N   F   Y   E   P   Q   I   I   T   T ·
     6401 CCATTGGTTC GTGACCCAAA GGAACTTTTA CGAGCCTCAA ATAATTACAA
             · D   N   T   F   V   S   G   N   C   D   V   V   I   G   I   V
     6451 CTGATAATAC ATTCGTTTCT GGAAATTGCG ACGTAGTTAT AGGTATTGTA
               N   N   T   V   Y   D   P   L   Q   P   E   L   D   S   F   K   E ·
     6501 AATAATACTG TTTATGACCC TTTACAACCT GAACTCGATT CCTTCAAGGA
          · E   L   D   K   Y   F   K   N   H   T   S   P   D   V   D   L   G ·
     6551 AGAACTCGAC AAATATTTTA AGAATCACAC CTCACCGGAC GTTGACTTAG
            · D   I   S   G   I   N   A   S   V   V   N   I   Q   K   E   I
     6601 GAGACATTTC CGGGATTAAC GCTAGTGTAG TCAATATCCA AAAGGAGATA
               D   R   L   N   E   V   A   K   N   L   N   E   S   L   I   D   L ·
     6651 GATAGACTGA ATGAGGTAGC AAAGAATCTT AATGAATCTT TGATCGACCT
          · Q   E   L   G   K   Y   E   Q   Y   I   K   W   P   W   Y   I   W ·
     6701 TCAGGAGCTG GGGAAGTACG AACAATACAT AAAATGGCCA TGGTACATTT
            · L   G   F   I   A   G   L   I   A   I   V   M   V   T   I   M
     6751 GGCTCGGGTT TATTGCTGGA CTAATTGCAA TAGTCATGGT CACTATCATG
               L   C   C   M   T   S   C   C   S   C   L   K   G   C   C   S   C ·
     6801 CTGTGTTGTA TGACATCGTG CTGCTCATGC CTCAAGGGAT GTTGTAGCTG
              ·     S   C   C   K   F   D   E   D   D   S   E   P   V   L   K   G ·
     6851 T■GATCTTGT TGCAAGTTCG ATGAGGATGA TTCAGAACCA GTTTTAAAAG
          · V   K   L   H   Y   T   *
     6901 GAGTAAAGTT GCATTACACA TAAAGGCTAG CTGTTTACGC GTTATCCATG
     6951 CTCAAAGAGG CCTCAATTAT ATTTGAGTTT TTAATTTTTA TGAAAAAAAC
                           M   E   V   H   D   F   E   T   D   E   F   N   D
     7001 TAACAGCAAT CATGGAAGTC CACGATTTTG AGACCGACGA GTTCAATGAT
              F   N   E   D   D   Y   A   T   R   E   F   L   N   P   D   E   R ·
     7051 TTCAATGAAG ATGACTATGC CACAAGAGAA TTCCTGAATC CCGATGAGCG
          · M   T   Y   L   N   H   A   D   Y   N   L   N   S   P   L   I   S ·
     7101 CATGACGTAC TTGAATCATG CTGATTACAA CCTGAATTCT CCTCTAATTA
          · D   D   I   D   N   L   I   R   K   F   N   S   L   P   I   P
     7151 GTGATGATAT TGACAATTTA ATCAGGAAAT TCAATTCTCT TCCAATTCCC
              S   M   W   D   S   K   N   W   D   G   V   L   E   M   L   T   S ·
     7201 TCGATGTGGG ATAGTAAGAA CTGGGATGGA GTTCTTGAGA TGTTAACGTC
          · C   Q   A   N   P   I   P   T   S   Q   M   H   K   W   M   G   S ·
     7251 ATGTCAAGCC AATCCCATCC CAACATCTCA GATGCATAAA TGGATGGGAA
            · W   L   M   S   D   N   H   D   A   S   Q   G   Y   S   F   L
     7301 GTTGGTTAAT GTCTGATAAT CATGATGCCA GTCAAGGGTA TAGTTTTTTA
              H   E   V   D   K   E   A   E   I   T   F   D   V   V   E   T   F ·
     7351 CATGAAGTGG ACAAAGAGGC AGAAATAACA TTTGACGTGG TGGAGACCTT
          · I   R   G   W   G   N   K   P   I   E   Y   I   K   K   E   R   W ·
     7401 CATCCGCGGC TGGGGCAACA AACCAATTGA ATACATCAAA AAGGAAAGAT
            · T   D   S   F   K   I   L   A   Y   L   C   Q   K   F   L   D
     7451 GGACTGACTC ATTCAAAATT CTCGCTTATT TGTGTCAAAA GTTTTTGGAC
              L   H   K   L   T   L   I   L   N   A   V   S   E   V   E   L   L ·
```

*Fig. 24G (cont.)*

```
7501 TTACACAAGT TGACATTAAT CTTAAATGCT GTCTCTGAGG TGGAATTGCT
      · N  L  A   R  T  F  K   G  V  R   R  S   S  H  G  T ·
7551 CAACTTGGCG AGGACTTTCA AAGGCAAAGT CAGAAGAAGT TCTCATGGAA
      · N  I  C   R  I  R   V  P  S   L  G  P   T  F  I  S
7601 CGAACATATG CAGGATTAGG GTTCCCAGCT TGGGTCCTAC TTTTATTTCA
        E  G  W   A  Y  F  K   K  L  D   I  L  M   D  R  N  F ·
7651 GAAGGATGGG CTTACTTCAA GAAACTTGAT ATTCTAATGG ACCGAAACTT
      · L  L  M   V  K  D  V   I  I  G   R  M  Q   T  V  L  S ·
7701 TCTGTTAATG GTCAAAGATG TGATTATAGG GAGGATGCAA ACGGTGCTAT
      · M  V  C   R  I  D   N  L  F  S   E  Q  D   I  F  S
7751 CCATGGTATG TAGAATAGAC AACCTGTTCT CAGAGCAAGA CATCTTCTCC
        L  L  N  I   Y  R  I   G  D  K   I  V  E  R   Q  G  N ·
7801 CTTCTAAATA TCTACAGAAT TGGAGATAAA ATTGTGGAGA GGCAGGGAAA
      · F  S  Y   D  L  I  K   M  V  E   P  I  C   N  L  K  L ·
7851 TTTTTCTTAT GACTTGATTA AAATGGTGGA ACCGATATGC AACTTGAAGC
      · M  K  L   A  R  E   S  R  P  L   V  P  Q   F  P  H
7901 TGATGAAATT AGCAAGAGAA TCAAGGCCTT TAGTCCCACA ATTCCCTCAT
         F  E  N  H   I  K  T   S  V  D   E  G  A  K   I  D  R ·
7951 TTTGAAAATC ATATCAAGAC TTCTGTTGAT GAAGGGGCAA AAATTGACCG
      · G  I  R   F  L  H  D   Q  I  M   S  V  K   T  V  D  L ·
8001 AGGTATAAGA TTCCTCCATG ATCAGATAAT GAGTGTGAAA ACAGTGGATC
       · T  L  V   I  Y  G   S  F  R  H   W  G  H   P  F  I
8051 TCACACTGGT GATTATATGA TCGTTCAGAC ATTGGGGTCA TCCTTTTATA
         D  Y  Y  T   G  L  E   K  L  H   S  Q  V  T   M  K  K ·
8101 GATTATTACA CTGGACTAGA AAAATTACAT TCCCAAGTAA CCATGAAGAA
      · D  I  D   V  S  Y  A   K  A  L   A  S  D   L  A  R  I ·
8151 AGATATTGAT GTGTCATATG CAAAAGCACT TGCAAGTGAT TTAGCTCGGA
        V  L  F   Q  Q  F   N  D  H  K   W  F   V  N  G
8201 TTGTTCTATT TCAACAGTTC AATGATCATA AAAAGTGGTT CGTGAATGGA
        D  L  L  P   H  D  H   P  F  K   S  H  V   K  E  N  T ·
8251 GACTTGCTCC CTCATGATCA TCCCTTTAAA AGTCATGTTA AAGAAAATAC
      · W  P  T   A  A  Q  V   Q  D  F   G  D  K   W  H  E  L ·
8301 ATGGCCCACA GCTGCTCAAG TTCAAGATTT TGGAGATAAA TGGCATGAAC
      · P  L  I   K  C  F   E  I  P  D   L  L  D   P  S  I
8351 TTCCGCTGAT TAAATGTTTT GAAATACCCG ACTTACTAGA CCCATCGATA
         I  Y  S  D   K  S  H   S  M  N   R  S  E  V   L  K  H ·
8401 ATATACTCTG ACAAAAGTCA TTCAATGAAT AGGTCAGAGG TGTTAAAACA
      · V  R  M   N  P  N  T   P  I  P   S  K  K   V  L  Q  T ·
8451 TGTCCGAATG AATCCGAACA CTCCTATCCC TAGTAAAAAG GTGTTGCAGA
        · M  L  D   T  K  A   T  N  W  K   E  F  L   K  E  I
8501 CTATGTTGGA CACAAAGGCT ACCAATTGGA AAGAATTTCT TAAAGAGATT
        D  E  K  G   L  D  D   D  D  L   I  I  G  L   K  G  K ·
8551 GATGAGAAGG GCTTAGATGA TGATGATCTA ATTATTGGTC TTAAAGGAAA
      · E  R  E   L  K  L  A   G  R  F   F  S  L   M  S  W  K ·
8601 GGAGAGGGAA CTGAAGTTGG CAGGTAGATT TTTCTCCCTA ATGTCTTGGA
      · L  R  E   Y  F  V   I  T  E  Y   L  I  K   T  H  F
8651 AATTGCGAGA ATACTTTGTA ATTACCGAAT ATTTGATAAA GACTCATTTC
         V  P  M  F   K  G  L   T  M  A   D  D  L  T   A  V  I ·
8701 GTCCCTATGT TTAAAGGCCT GACAATGGCG GACGATCTAA CTGCAGTCAT
      · K  K  M   L  D  S  S   S  G  Q   G  L  K   S  Y  E  A ·
8751 TAAAAAGATG TTAGATTCCT CATCCGGCCA AGGATTGAAG TCATATGAGG
      · I  C  I   A  N  H   I  D  Y  E   K  W  N   N  H  Q
8801 CAATTTGCAT AGCCAATCAC ATTGATTACG AAAAATGGAA TAACCACCAA
        R  K  L   S  N  G  P   V  F  R   V  M  G   Q  F  L  G ·
8851 AGGAAGTTAT CAAACGGCCC AGTGTTCCGA GTTATGGGCC AGTTCTTAGG
      · Y  P  S   L  I  E  R   T  H  E   F  F  E   K  S  L  I ·
8901 TTATCCATCC TTAATCGAGA GAACTCATGA ATTTTTTGAG AAAAGTCTTA
      · Y  Y  N   G  R  P   D  L  M  R   V  H  N   N  T  L
8951 TATACTACAA TGGAAGACCA GACTTGATGC GTGTTCACAA CAACACACTG
        I  N  S  T   S  Q  R   V  C  W   Q  G  Q  E   G  G  L ·
9001 ATCAATTCAA CCTCCCAACG AGTTTGTTGG CAAGGACAAG AGGGTGGACT
      · E  G  L   R  Q  K  G   W  S  I   L  N  L   L  V  I  Q ·
```

*Fig. 24G (cont.)*

```
9051 GGAAGGTCTA CGGCAAAAAG GATGGAGTAT CCTCAATCTA CTGGTTATTC
        · R   E   A   K   I   R   N   T   A   V   K   V   L   A   Q   G
9101 AAAGAGAGGC TAAAATCAGA AACACTGCTG TCAAAGTCTT GGCACAAGGT
            D   N   Q   V   I   C   T   Q   Y   K   T   K   K   S   R   N   V   ·
9151 GATAATCAAG TTATTTGCAC ACAGTATAAA ACGAAGAAAT CGAGAAACGT
        · V   E   L   Q   G   A   L   N   Q   M   V   S   N   N   E   K   I   ·
9201 TGTAGAATTA CAGGGTGCTC TCAATCAAAT GGTTTCTAAT AATGAGAAAA
        ·   M   T   A   I   K   I   G   T   G   K   L   G   L   L   I   N
9251 TTATGACTGC AATCAAAATA GGGACAGGGA AGTTAGGACT TTTGATAAAT
            D   D   E   T   M   Q   S   A   D   Y   L   N   Y   G   K   I   P   ·
9301 GACGATGAGA CTATGCAATC TGCAGATTAC TTGAATTATG GAAAAATACC
        · I   F   R   G   V   I   R   G   L   E   T   K   R   W   S   R   V   ·
9351 GATTTTCCGT GGAGTGATTA GAGGGTTAGA GACCAAGAGA TGGTCACGAG
        ·   T   C   V   T   N   D   Q   I   P   T   C   A   N   I   M   S
9401 TGACTTGTGT CACCAATGAC CAAATACCCA CTTGTGCTAA TATAATGAGC
        S   V   S   T   N   A   L   T   V   A   H   F   A   E   N   P   I   ·
9451 TCAGTTTCCA CAAATGCTCT CACCGTAGCT CATTTTGCTG AGAACCCAAT
        · N   A   M   I   Q   Y   N   Y   F   G   T   F   A   R   L   L   L   ·
9501 CAATGCCATG ATACAGTACA ATTATTTTGG GACATTTGCT AGACTCTTGT
            ·   M   M   H   D   P   A   L   R   Q   S   L   Y   E   V   Q   D
9551 TGATGATGCA TGATCCTGCT CTTCGTCAAT CATTGTATGA AGTTCAAGAT
            K   I   P   G   L   H   S   T   F   K   Y   A   M   L   Y   L   ·
9601 AAGATACCAG GCTTGCACAG TTCTACTTTC AAATACGCCA TGTTGTATTT
        · D   P   S   I   G   G   V   S   G   M   S   L   S   R   F   L   I   ·
9651 GGACCCTTCC ATTGGAGGAG TGTCGGGCAT GTCTTTGTCC AGGTTTTTGA
        ·   R   A   F   P   D   P   V   T   E   S   L   S   F   W   R   F
9701 TTAGAGCCTT CCCAGATCCC GTAACAGAAA GTCTCTCATT CTGGAGATTC
            I   H   V   H   A   R   S   E   H   L   K   E   M   S   A   V   F   ·
9751 ATCCATGTAC ATGCTCGAAG TGAGCATCTG AAGGAGATGA GTGCAGTATT
        · G   N   P   E   I   A   K   F   R   I   T   H   I   D   K   L   V   ·
9801 TGGAAACCCC GAGATAGCCA AGTTTCGAAT AACTCACATA GACAAGCTAG
        ·   E   D   P   T   S   L   N   I   A   M   G   M   S   P   A   N
9851 TAGAAGATCC AACCTCTCTG AACATCGCTA TGGGAATGAG TCCAGCGAAC
            L   L   K   T   E   V   K   C   L   I   E   S   R   Q   T   I   ·
9901 TTGTTAAAGA CTGAGGTTAA AAAATGCTTA ATCGAATCAA GACAAACCAT
        · R   N   Q   V   I   K   D   A   T   I   Y   L   Y   H   E   E   D   ·
9951 CAGGAACCAG GTGATTAAGG ATGCAACCAT ATATTTGTAT CATGAAGAGG
        · R   L   R   S   F   L   W   S   I   N   P   L   F   P   R   F
10001 ATCGGCTCAG AAGTTTCTTA TGGTCAATAA ATCCTCTGTT CCCTAGATTT
            L   S   E   F   K   S   G   T   F   L   G   V   A   D   G   L   I   ·
10051 TTAAGTGAAT TCAAATCAGG CACTTTTTTG GGAGTCGCAG ACGGGCTCAT
        · S   L   F   Q   N   S   R   T   I   R   N   S   F   K   K   K   Y   ·
10101 CAGTCTATTT CAAAATTCTC GTACTATTCG GAACTCCTTT AAGAAAAAGT
        ·   H   R   E   L   D   D   L   I   V   R   S   E   V   S   S   L
10151 ATCATAGGGA ATTGGATGAT TTGATTGTGA GGAGTGAGGT ATCCTCTTTG
            T   H   L   G   K   L   H   L   R   R   G   S   C   K   M   W   T   ·
10201 ACACATTTAG GGAAACTTCA TTTGAGAAGG GGATCATGTA AAATGTGGAC
        · C   S   A   T   H   A   D   T   L   R   Y   K   S   W   G   R   T   ·
10251 ATGTTCAGCT ACTCATGCTG ACACATTAAG ATACAAATCC TGGGGCCGTA
        ·   V   I   G   T   T   V   P   H   P   L   E   M   L   G   P   Q
10301 CAGTTATTGG GACAACTGTA CCCCATCCAT TAGAAATGTT GGGTCCACAA
            H   R   K   E   T   P   C   A   P   C   N   T   S   G   F   N   Y   ·
10351 CATCGAAAAG AGACTCCTTG TGCACCATGT AACACATCAG GGTTCAATTA
        · V   S   V   H   C   P   D   G   I   H   D   V   F   S   S   R   G   ·
10401 TGTTTCTGTG CATTGTCCAG ACGGGATCCA TGACGTCTTT AGTTCACGGG
        ·   P   L   P   A   Y   L   G   S   K   T   S   E   S   T   S   I
10451 GACCATTGCC TGCTTATCTA GGGTCTAAAA CATCTGAATC TACATCTATT
            L   Q   P   W   E   R   E   S   K   V   P   L   I   K   R   A   T   ·
10501 TTGCAGCCTT GGGAAAGGGA AAGCAAAGTC CCACTGATTA AAGAGCTAC
        · R   L   R   D   A   I   S   W   F   V   E   P   D   S   K   L   A   ·
10551 ACGTCTTAGA GATGCTATCT CTTGGTTTGT TGAACCCGAC TCTAAACTAG
            ·   M   T   I   L   S   N   I   H   S   L   T   G   E   E   W   T
```

*Fig. 24G (cont.)*

```
10601 CAATGACTAT ACTTTCTAAC ATCCACTCTT TAACAGGCGA AGAATGGACC
         K  R  Q  H  G  F  K  R  T  G  S  A  L  H  R  F  S  ·
10651 AAAAGGCAGC ATGGGTTCAA AAGAACAGGG TCTGCCCTTC ATAGGTTTTC
       ·  T  S  R  M  S  H  G  G  F  A  S  Q  S  T  A  A  L  ·
10701 GACATCTCGG ATGAGCCATG GTGGGTTCGC ATCTCAGAGC ACTGCAGCAT
       ·  T  R  L  M  A  T  T  D  T  M  R  D  L  G  D  Q
10751 TGACCAGGTT GATGGCAACT ACAGACACCA TGAGGGATCT GGGAGATCAG
          N  F  D  F  L  F  Q  A  T  L  L  Y  A  Q  I  T  T  ·
10801 AATTTCGACT TTTTATTCCA AGCAACGTTG CTCTATGCTC AAATTACCAC
       ·  T  V  A  R  D  G  W  I  T  S  C  T  D  H  Y  H  I  ·
10851 CACTGTTGCA AGAGACGGAT GGATCACCAG TTGTACAGAT CATTATCATA
       ·  A  C  K  S  C  L  R  P  I  E  E  I  T  L  D  S
10901 TTGCCTGTAA GTCCTGTTTG AGACCCATAG AAGAGATCAC CCTGGACTCA
          S  M  D  Y  T  P  P  D  V  S  H  V  L  K  T  W  R  ·
10951 AGTATGGACT ACACGCCCCC AGATGTATCC CATGTGCTGA AGACATGGAG
       ·  N  G  E  G  S  W  G  Q  E  I  K  Q  I  Y  P  L  E  ·
11001 GAATGGGGAA GGTTCGTGGG ACAAGAGAT AAAACAGATC TATCCTTTAG
       ·  G  N  W  K  N  L  A  P  A  E  Q  S  Y  Q  V  G
11051 AAGGGAATTG GAAGAATTTA GCACCTGCTG AGCAATCCTA TCAAGTCGGC
          R  C  I  G  F  L  Y  G  D  L  A  Y  R  K  S  T  H  ·
11101 AGATGTATAG GTTTTCTATA TGGAGACTTG GCGTATAGAA AATCTACTCA
       ·  A  E  D  S  S  L  F  P  L  S  I  Q  G  R  I  R  G  ·
11151 TGCCGAGGAC AGTTCTCTAT TTCCTCTATC TATACAAGGT CGTATTAGAG
       ·  R  G  F  L  K  G  L  L  D  G  L  M  R  A  S  C
11201 GTCGAGGTTT CTTAAAAGGG TTGCTAGACG GATTAATGAG AGCAAGTTGC
          C  Q  V  I  H  R  R  S  L  A  H  L  K  R  P  A  N  ·
11251 TGCCAAGTAA TACACCGGAG AAGTCTGGCT CATTTGAAGA GGCCGGCCAA
       ·  A  V  Y  G  G  L  I  Y  L  I  D  K  L  S  V  S  P  ·
11301 CGCAGTGTAC GGAGGTTTGA TTTACTTGAT TGATAAATTG AGTGTATCAC
       ·  P  F  L  S  L  T  R  S  G  P  I  R  D  E  L  E
11351 CTCCATTCCT TTCTCTTACT AGATCAGGAC CTATTAGAGA CGAATTAGAA
          T  I  P  H  K  I  P  T  S  Y  P  T  S  N  R  D  M  ·
11401 ACGATTCCCC ACAAGATCCC AACCTCCTAT CCGACAAGCA ACCGTGATAT
       ·  G  V  I  V  R  N  Y  F  K  Y  Q  C  R  L  I  E  K  ·
11451 GGGGGTGATT GTCAGAAATT ACTTCAAATA CCAATGCCGT CTAATTGAAA
       ·  G  K  Y  R  S  H  Y  S  Q  L  W  L  F  S  D  V
11501 AGGGAAAATA CAGATCACAT TATTCACAAT TATGGTTATT CTCAGATGTC
          L  S  I  D  F  I  G  P  F  S  I  S  T  T  L  L  Q  ·
11551 TTATCCATAG ACTTCATTGG ACCATTCTCT ATTTCCACCA CCCTCTTGCA
       ·  I  L  Y  K  P  F  L  S  G  K  D  K  N  E  L  R  E  ·
11601 AATCCTATAC AAGCCATTTT TATCTGGGAA AGATAAGAAT GAGTTGAGAG
       ·  L  A  N  L  S  S  L  L  R  S  G  E  G  W  E  D
11651 AGCTGGCAAA TCTTTCTTCA TTGCTAAGAT CAGGAGAGGG GTGGGAAGAC
          I  H  V  K  F  F  T  K  D  I  L  L  C  P  E  E  I  ·
11701 ATACATGTGA AATTCTTCAC CAAGGACATA TTATTGTGTC CAGAGGAAAT
       ·  R  H  A  C  K  F  G  I  A  K  D  N  N  K  D  M  S  ·
11751 CAGACATGCT TGCAAGTTCG GGATTGCTAA GGATAATAAT AAAGACATGA
       ·  Y  P  P  W  G  R  E  S  R  G  T  I  T  T  I  P
11801 GCTATCCCCC TTGGGGAAGG GAATCCAGAG GGACAATTAC AACAATCCCT
          V  Y  Y  T  T  P  Y  P  K  M  L  E  M  P  P  R  ·
11851 GTTTATTATA CGACCACCCC TTACCCAAAG ATGCTAGAGA TGCCTCCAAG
       ·  I  Q  N  P  L  L  S  G  I  R  L  G  Q  L  P  T  G  ·
11901 AATCCAAAAT CCCCTGCTGT CCGGAATCAG GTTGGGCCAA TTACCAACTG
       ·  A  H  Y  K  I  R  S  I  L  H  G  M  G  I  H  Y
11951 GCGCTCATTA TAAAATTCGG AGTATATTAC ATGGAATGGG AATCCATTAC
          R  D  F  L  S  C  G  D  G  S  G  G  M  T  A  A  L  ·
12001 AGGGACTTCT TGAGTTGTGG AGACGGCTCC GGAGGGATGA CTGCTGCATT
       ·  L  R  E  N  V  H  S  R  G  I  F  N  S  L  L  E  L  ·
12051 ACTACGAGAA AATGTGCATA GCAGAGGAAT ATTCAATAGT CTGTTAGAAT
       ·  S  G  S  V  M  R  G  A  S  P  E  P  P  S  A  L
12101 TATCAGGGTC AGTCATGCGA GGCGCCTCTC CTGAGCCCCC CAGTGCCCTA
          E  T  L  G  G  D  K  S  R  C  V  N  G  E  T  C  W  ·
```

*Fig. 24G (cont.)*

```
12151 GAAACTTTAG GAGGAGATAA ATCGAGATGT GTAAATGGTG AAACATGTTG
        · E  Y  P   S  D  L   C  D  P   R  T  W   D  Y  F  L  R ·
12201 GGAATATCCA TCTGACTTAT GTGACCCAAG GACTTGGGAC TATTTCCTCC
        · L  K  A   G  L  G   L  Q  I  D  L  I  V   M  D  M
12251 GACTCAAAGC AGGCTTGGGG CTTCAAATTG ATTTAATTGT AATGGATATG
          E  V  R  D  S  S  T   S  L  K   I  E  T  N  V  R  N ·
12301 GAAGTTCGGG ATTCTTCTAC TAGCCTGAAA ATTGAGACGA ATGTTAGAAA
        · Y  V  H   R  I  L  D   E  Q  G   V  L  I   Y  K  T  Y ·
12351 TTATGTGCAC CGGATTTTGG ATGAGCAAGG AGTTTTAATC TACAAGACTT
        · G  T  Y   I  C  E   S  E  K  N   A  V  T   I  L  G
12401 ATGGAACATA TATTTGTGAG AGCGAAAAGA ATGCAGTAAC AATCCTTGGT
          P  M  F  K  T  V  D   L  V  Q   T  E  F   S  S  S  Q ·
12451 CCCATGTTCA AGACGGTCGA CTTAGTTCAA ACAGAATTTA GTAGTTCTCA
        · T  S  E   V  Y  M  V   C  K  G   L  K  K   L  I  D  E ·
12501 AACGTCTGAA GTATATATGG TATGTAAAGG TTTGAAGAAA TTAATCGATG
        · P  N  P   D  W  S   S  I  N  E   S  W  K   N  L  Y
12551 AACCCAATCC CGATTGGTCT TCCATCAATG AATCCTGGAA AAACCTGTAC
          A  F  Q  S  S  E  Q   E  F  A   R  A  K  K   V  S  T ·
12601 GCATTCCAGT CATCAGAACA GGAATTTGCC AGAGCAAAGA AGGTTAGTAC
        · Y  F  T   L  T  G  I   P  S  Q   F  I  P   D  P  F  V ·
12651 ATACTTTACC TTGACAGGTA TTCCCTCCCA ATTCATTCCT GATCCTTTTG
        · N  I  E   T  M  L   Q  I  F  G   V  P  T   G  V  S
12701 TAAACATTGA GACTATGCTA CAAATATTCG GAGTACCCAC GGGTGTGTCT
          H  A  A  A  L  K  S   S  D  R   P  A  D  L   L  T  I ·
12751 CATGCGGCTG CCTTAAAATC ATCTGATAGA CCTGCAGATT TATTGACCAT
        · S  L  F   Y  M  A  I   I  S  Y   Y  N  I   N  H  I  R ·
12801 TAGCCTTTTT TATATGGCGA TTATATCGTA TTATAACATC AATCATATCA
        · V  G  P   I  P  P   N  P  P  S   D  G  I   A  Q  N
12851 GAGTAGGACC GATACCTCCG AACCCCCCAT CAGATGGAAT TGCACAAAAT
          V  G  I  A  I  T  G   I  S  F   W  L  S  L   M  E  K ·
12901 GTGGGGATCG CTATAACTGG TATAAGCTTT TGGCTGAGTT TGATGGAGAA
        · D  I  P   L  Y  Q  Q   C  L  A   V  I  Q   Q  S  F  P ·
12951 AGACATTCCA CTATATCAAC AGTGTTTAGC AGTTATCCAG CAATCATTCC
        · I  R  W   E  A  V   S  V  K  G   G  Y  K   Q  K  W
13001 CGATTAGGTG GGAGGCTGTT TCAGTAAAAG GAGGATACAA GCAGAAGTGG
          S  T  R  G  D  G  L   P  K  D   T  R  I  S   D  S  L ·
13051 AGTACTAGAG GTGATGGGCT CCCAAAAGAT ACCCGAATTT CAGACTCCTT
        · A  P  I   G  N  W  I   R  S  L   E  L  V   R  N  Q  V ·
13101 GGCCCCAATC GGGAACTGGA TCAGATCTCT GGAATTGGTC GAAACCAAG
        · R  L  N   P  F  N   E  I  L  F   N  Q  L   C  R  T
13151 TTCGTCTAAA TCCATTCAAT GAGATCTTGT TCAATCAGCT ATGTCGTACA
          V  D  N  H  L  K  W   S  N  L   R  R  N  T   G  M  I ·
13201 GTGGATAATC ATTTGAAATG GTCAAATTTG CGAAGAAACA CAGGAATGAT
        · E  W  I   N  R  R  I   S  K  E   D  R  S   I  L  M  L ·
13251 TGAATGGATC AATAGACGAA TTTCAAAAGA AGACCGGTCT ATACTGATGT
        · K  S  D   L  H  E   E  N  S  W   R  D  *
13301 TGAAGAGTGA CCTACACGAG GAAAACTCTT GGAGAGATTA AAAAATCATG
13351 AGGAGACTCC AAACTTTAAG TATGAAAAAA ACTTTGATCC TTAAGACCCT
13401 CTTGTGGTTT TTATTTTTTA TCTGGTTTTG TGGTCTTCGT
```

*Fig. 24G (cont.)*

| Serum-containing medium clones | | |
|---|---|---|
| clone number | NT50 (1/dilution) | VC average plaque count |
| SC1 | 892.7 | 18.0 |
| SC3 | 845.4 | 5.5 |
| SC7 | 270.1 | 29.8 |
| MB2 | 2665.0 | 10.6 |

| Round 1 clones | | |
|---|---|---|
| clone number | NT50 (1/dilution) | VC average plaque count |
| A*/7/2/A3/1 | 841.2 | 26.5 |
| A*/8/4/A3/1 | 143.6 | 48.8 |
| A*/7/1/A3/1 | 478.8 | 22.4 |
| A*/8/2/A2/1 | 1134.0 | 22.9 |
| A*/7/1/A2/2 | 311.2 | 29.9 |
| A*/7/1/A1/1 | 478.8 | 16.6 |
| A*/7/1/B1/1 | 1134.0 | 13.6 |
| A*/8/2/B2/1 | 311.2 | 29.8 |
| A*/9/1/B2/1 | 942.7 | 17.4 |
| A*/9/4/B2/1 | 702.4 | 28.0 |
| A*/7/1/A3/2 | 347.1 | 26.4 |
| A*/8/3/A3/1 | 530.1 | 23.5 |
| A*/7/1/B1/2 | 1565.0 | 44.6 |
| A*/7/1/A2/1 | 2321.0 | 22.0 |
| A*/7/2/B1/1 | 794.5 | 21.3 |
| A*/7/1/B2/1 | 110.4 | 60.4 |
| A*/8/3/B1/1 | 673.3 | 28.8 |

| Serum-free medium clones | | |
|---|---|---|
| clone number | NT50 (1/dilution) | VC average plaque count |
| SF1 | 299.0 | 32.9 |
| SF2 | 1563.0 | 21.9 |
| SF3 | 1929.0 | 19.8 |
| SF4 | 770.6 | 6.8 |
| SF5 | 1014.0 | 28.3 |
| SF6 | 121.9 | 32.0 |
| SF7 | 571.3 | 24.0 |
| SF8 | 381.3 | 42.0 |
| SF9 | 594.4 | 26.5 |
| SF10 | 475.1 | 45.8 |
| SF11 | 1094.0 | 23.5 |
| SF12 | 1271.0 | 28.0 |
| SF13 | 414.9 | 24.0 |
| SF14 | 725.5 | 22.8 |
| SF15 | 477.6 | 33.8 |
| SF16 | 601.6 | 21.6 |
| SF17 | 660.4 | 25.4 |
| SF18 | 339.6 | 24.3 |
| SF19 | 458.3 | 18.6 |
| MB1 | 1887.0 | 19.4 |

REPLICATION-COMPETENT ATTENUATED CHIMERIC VSV VECTORS ENCODING IMMUNOGENIC SARS-CoV-2 SPIKE PROTEINS

GOVERNMENT RIGHTS IN INVENTION

This invention was made with Government support under HHSO100201600031C awarded by Assistant Secretary of Preparedness and Response, Biomedical Advanced Research and Development Authority (ASPR-BARDA). The Government has certain rights in the invention.

FIELD

The present disclosure relates to recombinant vesicular stomatitis virus (VSV) for use as vaccines for infectious coronavirus disease COVID-19.

BACKGROUND

The recent outbreak of coronavirus disease COVID-19 is caused by a novel coronavirus 2019-nCoV, which is officially named Severe Acute Respiratory Syndrome coronavirus 2 (SARS-CoV-2) and sometimes referred to as the Wuhan coronavirus. Since the report of the first COVID-19 case in Wuhan, China, in November 2019, 27.9 million COVID-19 cases have been confirmed globally with more than 898,000 reported deaths as of Sep. 10, 2020. As a member of the large coronavirus family that causes sickness from the common cold to more severe diseases such as the Severe Acute Respiratory Syndrome (SARS) and the Middle East Respiratory Syndrome (MERS), the SARS-CoV-2 is a coronavirus that was not found in humans before this outbreak. Although infection with SARS-CoV-2 does not appear to be as deadly, with respect to case fatality rate, as infection with the SARS or MERS viruses, SARS-CoV-2 appears to be more infectious and able to be transmitted from infected people before the onset of symptoms. As a result, it is spreading far wider and more quickly than SARS or MERS and, as a result, is now responsible for the deaths of far more people worldwide. Some scientists have predicted that the SARS-CoV-2 may become endemic in human populations and potentially return every winter like other respiratory pathogens such as influenza. Many leading scientists believe that the infection will only be eradicated from human populations when a safe and effective vaccine to prevent SARS-CoV-2 infection is available.

The SARS-CoV-2 is genetically related to coronaviruses that infect bats. Like many other highly pathogenic viruses that originate from animal reservoirs, such as those that cause outbreaks of hemorrhagic fever like Ebola virus (EBOV), Lassa virus (LASV), and Marburg virus (MARV), the SARS-CoV-2 is an enveloped RNA virus. Viruses in this highly diverse category all have one or more multimeric glycoproteins exposed on their surface that play essential roles in infection of the host, notably during cell attachment and virus entry. Glycoproteins also are known to be the primary targets for protective immunity.

Sequences of more than seventy (70) SARS-CoV-2 variants have been published. Structural studies of these published sequences have been reported. It is believed that SARS-CoV-2 expresses a spike (S) protein that contains a receptor-binding domain (RBD), including receptor-binding motif (RBM), and interacts with host receptor angiotensin-converting enzyme 2 (ACE2). See Zhou, P. et al. A pneumonia outbreak associated with a new coronavirus of probable bat origin, Nature 579:270-273 (published online 3 Feb. 2020); see also Wan, Y. et al. Receptor recognition by novel coronavirus from Wuhan: An analysis based on decade-long structural studies of SARS, J. Virol. 94(7): e00127-20, doi:10.1128/JVI.00127-20 (published online 29 Jan. 2020). The S protein comprises two subunits S1 (the surface unit, which binds the receptor) and S2 (the transmembrane unit, which facilitates viral fusion to cell membranes). The S protein is activated by cleavage at the spike S1/S2 site by host cell proteases and SARS-CoV-2 has a newly formed Furin cleavage site at the S1/S2 interface.

There remains a need to identify immunogenic antigens derived from the SARS-CoV-2 and develop vaccine compositions that are able to be produced at large scale using available manufacturing processes that stably express such immunogenic antigens for inducing relevant immune responses in vaccinated individuals to enable them to be protected against COVID-19 and that are able to be produced at large scale using available manufacturing processes.

SUMMARY

The present disclosure relates to vectors, virus particles, immunogenic recombinant proteins, and vaccines that relate to Severe Acute Respiratory Syndrome coronavirus 2 (SARS-CoV-2). The disclosure includes multiple embodiments, including, but not limited to, the following embodiments.

Embodiment 1 is a recombinant VSV vector comprising:
a. at least a portion of the VSV genome comprising at least a VSV-N gene, VSV-P gene, VSV-M gene, and VSV-L gene, and
b. a nucleic acid sequence encoding a SARS-CoV-2 S protein or an immunogenic variant thereof.

Embodiment 2 is a recombinant VSV particle comprising the vector of embodiment 1 and displaying the S protein or an immunogenic variant thereof on the surface of the VSV particle.

Embodiment 3 is a recombinant VSV particle comprising:
a. at least a portion of the VSV genome comprising N, P, M, and L genes and
b. a nucleic acid sequence encoding a SARS-CoV-2 S protein or an immunogenic variant thereof.

Embodiment 4 is the recombinant VSV particle of embodiment 2 or 3, wherein the VSV particle is replicable.

Embodiment 5 is the recombinant VSV particle of any one of embodiments 3-4, wherein the VSV particle displays the S protein or an immunogenic variant thereof on the surface of the VSV particle.

Embodiment 6 is an immunogenic recombinant protein comprising a SARS-CoV-2 S protein or an immunogenic variant thereof expressed by the recombinant VSV vector of embodiment 1 or recombinant VSV particle of any one of embodiments 2-5.

Embodiment 7 is an immunogenic recombinant protein comprising a SARS-CoV-2 S protein or an immunogenic variant thereof and at least a fragment of a VSV glycoprotein (G).

Embodiment 8 is a SARS-CoV-2 vaccine comprising the recombinant VSV vector of embodiment 1, recombinant VSV particle of any one of embodiments 2-5, or immunogenic recombinant protein of embodiment 6 or 7.

Embodiment 9 is the recombinant VSV vector of embodiment 1, recombinant VSV particle of any one of embodiments 2-5, immunogenic recombinant protein of embodiment 6 or 7, or SARS-CoV-2 vaccine of embodiment 8, wherein the SARS-CoV-2 S protein or an immunogenic variant thereof comprises an amino acid sequence having a length of at least 1223, 1228, 1233, 1238, 1243, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277 or 1278 amino acids and having homology over its own length of at least 90, 91, 92, 93, 94, 95, 96, 97, 98, or 99% homology to any one of SEQ ID NOS: 1, 4, 7, 10, 13, 16, 19, 22, 25-67, 153, or 158.

Embodiment 10 is the recombinant VSV vector of embodiment 1 or 9, recombinant VSV particle of any one of embodiments 2-5 or 9, or SARS-CoV-2 vaccine of embodiment 8 or 9, wherein the VSV genome comprises at least a fragment of a VSV-G gene.

Embodiment 11 is the recombinant VSV vector of any one of embodiments 1, 9, or 10, recombinant VSV particle of any one of embodiments 2-5, 9 or 10, immunogenic recombinant protein of any one of embodiments 6, 7, or 9, or SARS-CoV-2 vaccine of any one of embodiments 8-10, wherein the immunogenic variant of the SARS-CoV-2 S protein is a fragment of the SARS-CoV-2 S protein having a deletion at the C-terminal end of the SARS-CoV-2 S protein.

Embodiment 12 is the recombinant VSV vector of any one of embodiments 1, or 9-11, recombinant VSV particle of any one of embodiments 2-5 or 9-11, immunogenic recombinant protein of any one of embodiments 6, 7, 9, or 11, or SARS-CoV-2 vaccine of any one of embodiments 8-11, wherein the immunogenic variant of the SARS-CoV-2 S protein comprises a fragment of the SARS-CoV-2 S protein having a deletion of from 5-25 or 9-23 amino acids at the C-terminal end of the SARS-CoV-2 S protein.

Embodiment 13 is the recombinant VSV vector of any one of embodiments 1, or 9-12, recombinant VSV particle of any one of embodiments 2-5 or 9-12, immunogenic recombinant protein of any one of embodiments 6, 7, 9, 11, or 12, or SARS-CoV-2 vaccine of any one of embodiments 8-12, wherein the immunogenic variant of the SARS-CoV-2 S protein comprises a fragment of the SARS-CoV-2 S protein having a deletion of 9, 13, 19, 21 or 23 amino acids at the C-terminal end of the SARS-CoV-2 S protein.

Embodiment 14 is the recombinant VSV vector of any one of embodiments 1 or 9-13, recombinant VSV particle of any one of embodiments 2-5 or 9-13, immunogenic recombinant protein of any one of embodiments 6, 7, 9, or 11-13, or SARS-CoV-2 vaccine of any one of embodiments 8-13, wherein (a) the portion of the VSV genome comprises a nucleic acid sequence encoding at least 21 amino acids at the C-terminal end of the VSV-G protein or (b) the immunogenic recombinant protein comprises at least 21 amino acids at the C-terminal end of the VSV-G protein.

Embodiment 15 is the recombinant VSV vector of any one of embodiments 1 or 9-14, recombinant VSV particle of any one of embodiments 2-5 or 9-14, immunogenic recombinant protein of any one of embodiments 6, 7, 9, or 11-14, or SARS-CoV-2 vaccine of any one of embodiments 8-14, wherein (a) the portion of the VSV genome comprises a nucleic acid sequence encoding at least 29 amino acids at the C-terminal end of the VSV-G protein or (b) the immunogenic recombinant protein comprises at least 29 amino acids at the C-terminal end of the VSV-G protein.

Embodiment 16 is the recombinant VSV vector of any one of embodiments 1 or 9-15, recombinant VSV particle of any one of embodiments 2-5 or 9-15, immunogenic recombinant protein of any one of embodiments 6, 7, 9, or 11-15, or SARS-CoV-2 vaccine of any one of embodiments 8-15, wherein the immunogenic variant of the SARS-CoV-2 S protein comprises at least one mutation in the exposed loop (a solvent-exposed loop that comprises the S1/S2 cleavage site) of the SARS-CoV-2 S protein.

Embodiment 17 is the recombinant VSV vector of any one of embodiments 1 or 9-16, recombinant VSV particle of any one of embodiments 2-5 or 9-16, immunogenic recombinant protein of any one of embodiments 6, 7, 9, or 11-16, or SARS-CoV-2 vaccine of any one of embodiments 8-16, wherein the immunogenic variant of the SARS-CoV-2 S protein comprises at least one mutation in the S1/S2 cleavage site (Furin).

Embodiment 18 is the recombinant VSV vector, recombinant VSV particle, immunogenic recombinant protein, or SARS-CoV-2 vaccine of embodiment 17, wherein the at least one mutation in the S1/S2 cleavage site (Furin) reduces or blocks S1/S2 cleavage of the immunogenic variant of the SARS-CoV-2 S protein as compared with that of wild-type SARS-CoV-2 S protein.

Embodiment 19 is the recombinant VSV vector of any one of embodiments 1 or 9-16, recombinant VSV particle of any one of embodiments 2-5 or 9-16, immunogenic recombinant protein of any one of embodiments 6, 7, 9, or 11-16, or SARS-CoV-2 vaccine of any one of embodiments 8-16, wherein the immunogenic variant of the SARS-CoV-2 protein comprises at least one mutation in the S2' cleavage site (Cathepsin H, L).

Embodiment 20 is the recombinant VSV vector, recombinant VSV particle, immunogenic recombinant protein, or SARS-CoV-2 vaccine of embodiment 19, wherein the at least one mutation in the S2' cleavage site (Cathepsin H, L) modulates S2' cleavage of the immunogenic variant of the SARS-CoV-2 S protein as compared with that of wild-type SARS-CoV-2 S S2'.

Embodiment 21 is the recombinant VSV vector of any one of embodiments 1 or 9-20, recombinant VSV particle of any one of embodiments 2-5 or 9-20, immunogenic recombinant protein of any one of embodiments 6, 7, 9, or 11-20, or SARS-CoV-2 vaccine of any one of embodiments 8-20, wherein the immunogenic variant of the SARS-CoV-2 protein comprises one or more mutations relative to SEQ ID NO: 1 chosen from a mutation at residue 655, one or more mutations from residue 672 to residue 687, one or more mutations from residue 802 to residue 817, one or more mutations from residue 1233 to residue 1273, and combinations thereof.

Embodiment 22 is the recombinant VSV vector, recombinant VSV particle, immunogenic recombinant protein, or SARS-CoV-2 vaccine of embodiment 21, comprising a mutation at residues 655, wherein the mutation at residue 655 is H655Y.

Embodiment 23 is the recombinant VSV vector, recombinant VSV particle, immunogenic recombinant protein, or SARS-CoV-2 vaccine of embodiment 21 or 22, comprising one or more mutations from residue 672 to 687, wherein the one or more mutations from residue 672 to residue 687 are from residue 678 to residue 685.

Embodiment 24 is the recombinant VSV vector, recombinant VSV particle, immunogenic recombinant protein, or SARS-CoV-2 vaccine of any one of embodiments 21-23, comprising one or more mutations from residue 672 to residue 687, wherein the one or more mutations from residue 678 to residue 685 are chosen from T678I, P681S, R682K, R683G, R685G, and combinations thereof.

Embodiment 25 is the recombinant VSV vector, recombinant VSV particle, immunogenic recombinant protein, or SARS-CoV-2 vaccine of any one of embodiments 21-24, comprising one more mutations from residue 802 to residue 817, wherein the one or more mutations from residue 802 to residue 817 in SEQ ID NO: 1 are from residue 810 to residue 815.

Embodiment 26 is the recombinant VSV vector, recombinant VSV particle, immunogenic recombinant protein, or SARS-CoV-2 vaccine of any one of embodiments 21-25, comprising one or more mutations from residue 810 to residue 815, wherein the one or more mutations from residue 810 to residue 815 are chosen from P812R, S813R, S813F, and combinations thereof.

Embodiment 27 is the recombinant VSV vector of embodiment 1 or 9, recombinant VSV particle of any one of embodiments 2-5 or 9, or SARS-CoV-2 vaccine of embodiment 8 or 9, wherein:
  a. the recombinant VSV vector is rVSVΔG-SARS-CoV-2 clone MB2, which has the nucleic acid sequence set forth in SEQ ID NO: 154; or
  b. the recombinant VSV vector, recombinant VSV particle, or SARS-CoV-2 vaccine comprises nucleic acids encoding
    i. a VSV L protein, which has the amino acid sequence set forth in SEQ ID NO: 152;
    ii. a VSV N protein, which has the amino acid sequence set forth in SEQ ID NO: 155;
    iii. a VSV P protein, which has the amino acid sequence set forth in SEQ ID NO: 156;
    iv. a VSV M protein, which has the amino acid sequences set forth in SEQ ID NO: 157; and
    v. a SARS-CoV-2 S protein, which has the amino acid sequence set forth in SEQ ID NO: 158.

Embodiment 28 is the recombinant VSV particle of any one of embodiments 2-5 or 9 or SARS-CoV-2 vaccine of embodiment 8 or 9, wherein the particle or vaccine comprises:
  a. VSV L protein, which has the amino acid sequence set forth in SEQ ID NO: 152;
  b. VSV N protein, which has the amino acid sequence set forth in SEQ ID NO: 155;
  c. VSV P protein, which has the amino acid sequence set forth in SEQ ID NO: 156;
  d. VSV M protein, which has the amino acid sequence set forth in SEQ ID NO: 157; and e. SARS-CoV-2 S protein, which has the amino acid sequence set forth in SEQ ID NO: 158.

Embodiment 29 is the recombinant VSV vector of any one of embodiments 1, or 9-26, recombinant VSV particle of any one of embodiments 2-5 or 9-26, immunogenic recombinant protein of any one of embodiments 6, 7, 9, or 11-26, or SARS-CoV-2 vaccine of any one of embodiments 8-26, wherein the immunogenic variant of the S protein does not comprise the entire cytoplasmic tail.

Embodiment 30 is the recombinant VSV vector of any one of embodiments 1, 9-26, or 29, recombinant VSV particle of any one of embodiments 2-5, 9-26, or 29, immunogenic recombinant protein of any one of embodiments 6, 7, 9, 11-26, or 29, or SARS-CoV-2 vaccine of any one of embodiments 8-26 or 29, wherein the immunogenic variant of the S protein does not comprise the endoplasmic reticulum retention sequence.

Embodiment 31 is the recombinant VSV vector of any one of embodiments 1, 9-26, 29, or 30, recombinant VSV particle of any one of embodiments 2-5, 9-26, 29, or 30, immunogenic recombinant protein of any one of embodiments 6, 7, 9, 11-26, 29, or 30, or SARS-CoV-2 vaccine of any one of embodiments 8-26, 29, or 30, wherein the immunogenic variant of the S protein has a 23 amino acid deletion at the C-terminal domain relative to SEQ ID NO: 1.

Embodiment 32 is the recombinant VSV vector of any one of embodiments 1, 9-26, or 29-31, recombinant VSV particle of any one of embodiments 2-5, 9-26, or 29-31, immunogenic recombinant protein of any one of embodiments 6, 7, 9, 11-26, or 29-31, or SARS-CoV-2 vaccine of any one of embodiments 8-26 or 29-31, wherein the immunogenic variant of the S protein has a deletion at position 1251 relative to SEQ ID NO: 1.

Embodiment 33 is the recombinant VSV vector of any one of embodiments 1, 9-26, or 29-32, recombinant VSV particle of any one of embodiments 2-5, 9-26, or 29-32, immunogenic recombinant protein of any one of embodiments 6, 7, 9, 11-26, or 29-32, or SARS-CoV-2 vaccine of any one of embodiments 8-26 or 29-32, wherein the immunogenic variant of the S protein comprises an H655Y mutation relative to SEQ ID NO: 1.

Embodiment 34 is the recombinant VSV vector of any one of embodiments 1, 9-26, or 29-33, recombinant VSV particle of any one of embodiments 2-5, 9-26, or 29-33, immunogenic recombinant protein of any one of embodiments 6, 7, 9, 11-26, or 29-33, or SARS-CoV-2 vaccine of any one of embodiments 8-26 or 29-33, wherein the immunogenic variant of the SARS-CoV-2 S protein comprises one or more mutations from residue 1233 to residue 1273 in SEQ ID NO: 1, wherein the one or more mutations from residue 1233 to residue 1273 are chosen from a deletion at the C-terminal end of the SEQ ID NO: 1, M1233K, and a combination thereof.

Embodiment 35 is the recombinant VSV vector of claim 1 or 9, recombinant VSV particle of any one of claims 2-5 or 9, or SARS-CoV-2 vaccine of claim 8 or 9, wherein:
  a. the recombinant VSV vector is rVSVΔG-SARS-CoV-2 clone MB1, which has the nucleic acid sequence set forth in SEQ ID NO: 150; or
  b. the recombinant VSV vector, recombinant VSV particle, or SARS-CoV-2 vaccine comprises nucleic acids encoding
    i. VSV L protein, which has the amino acid sequence set forth in SEQ ID NO: 152;
    ii. VSV N protein, which has the amino acid sequence set forth in SEQ ID NO: 155;
    iii. VSV P protein, which has the amino acid sequence set forth in SEQ ID NO: 156;
    iv. VSV M protein, which has the amino acid sequence set forth in SEQ ID NO: 153; and
    v. SARS-CoV-2 S protein, which has the amino acid sequence set forth in SEQ ID NO: 151.

Embodiment 36 is the recombinant VSV particle of any one of claims 2-5 or 9 or SARS-CoV-2 vaccine of claim 8 or 9, wherein the particle or vaccine comprises VSV and SARS-CoV-2 proteins from MB1 comprising:
  a. VSV L protein, which has the amino acid sequence set forth in SEQ ID NO: 152;
  b. VSV N protein, which has the amino acid sequence set forth in SEQ ID NO: 155;
  c. VSV P protein, which has the amino acid sequence set forth in SEQ ID NO: 156;
  d. VSV M protein, which has the amino acid sequence set forth in SEQ ID NO: 151; and
  e. SARS-CoV-2 S protein, which has the amino acid sequence set forth in SEQ ID NO: 153.

Embodiment 37 is the recombinant VSV vector of any one of embodiments 1, 9-28, or 30-34, recombinant VSV particle of any one of embodiments 2-5, 9-28, or 30-34, immunogenic recombinant protein of any one of embodiments 6, 7, 9, 11-28, or 30-34, or SARS-CoV-2 vaccine of any one of embodiments 8-28 or 30-34, wherein the immunogenic variant of the S protein does not comprise the entire cytoplasmic tail (i.e., does not comprise the entire cytoplasmic tail of the S protein).

Embodiment 38 is the recombinant VSV vector of any one of embodiments 1, 9-29, 31-34, or 37, recombinant VSV particle of any one of embodiments 2-5, 9-29, 31-34, or 37, immunogenic recombinant protein of any one of embodiments 6, 7, 9, 11-29, 31-34, or 37, or SARS-CoV-2 vaccine of any one of embodiments 8-29, 31-34, or 37, wherein the immunogenic variant of the S protein does not comprise the endoplasmic reticulum retention sequence (i.e., does not comprise the endoplasmic reticulum retention sequence of the SARS-CoV-2 S protein).

Embodiment 39 is the recombinant VSV vector of any one of embodiments 1, 9-30, 32-34, 37, or 38, recombinant VSV particle of any one of embodiments 2-5, 9-30, 32-34, 37, or 38, immunogenic recombinant protein of any one of embodiments 6, 7, 9, 11-30, 32-34, 37, or 38, or SARS-CoV-2 vaccine of any one of embodiments 8-30, 32-34, 37, or 38, wherein the immunogenic variant of the S protein has a 23 amino acid deletion at the C-terminal domain.

Embodiment 40 is the recombinant VSV vector of any one of embodiments 1, 9-31, 33, 34, or 37-39, recombinant VSV particle of any one of embodiments 2-5, 9-31, 33, 34, or 37-39, immunogenic recombinant protein of any one of embodiments 6, 7, 9, 11-31, 33, 34, or 37-39, or SARS-CoV-2 vaccine of any one of embodiments 8-31, 33, 34, or 37-39, wherein the immunogenic variant of the S protein has a deletion at position 1251.

Embodiment 41 is the recombinant VSV vector of any one of embodiments 1, 9-34, or 37-40, recombinant VSV particle of any one of embodiments 2-5, 9-34, or 37-40, immunogenic recombinant protein of any one of embodiments 6, 7, 9, 11-34, or 37-40, or SARS-CoV-2 vaccine of any one of embodiments 8-34, or 37-40, wherein the immunogenic variant of the S protein comprises an R683G mutation relative to SEQ ID NO: 1.

Embodiment 42 is the recombinant VSV vector of any one of embodiments 1, 9-41, recombinant VSV particle of any one of embodiments 2-5, 9-41, immunogenic recombinant protein of any one of embodiments 6, 7, 9, 11-41, or SARS-CoV-2 vaccine of any one of embodiments 8-41, wherein the immunogenic variant of the S protein does not comprise a mutation at R685 relative to SEQ ID NO: 1.

Embodiment 43 is the recombinant VSV vector of any one of embodiments 1, 9-42, recombinant VSV particle of any one of embodiments 2-5, 9-42, immunogenic recombinant protein of any one of embodiments 6, 7, 9, 11-42, or SARS-CoV-2 vaccine of any one of embodiments 8-42, wherein the immunogenic variant of the S protein does not have a 24 amino acid deletion at the C-terminal domain.

Embodiment 44 is the recombinant VSV vector of any one of embodiments 1, 9-42, recombinant VSV particle of any one of embodiments 2-5, 9-42, immunogenic recombinant protein of any one of embodiments 6, 7, 9, 11-42, or SARS-CoV-2 vaccine of any one of embodiments 8-42, wherein the immunogenic variant of the S protein does not comprise a 21 amino acid deletion at the C-terminal cytoplasmic domain.

Embodiment 45 is the recombinant VSV vector of any one of embodiments 1, 9-44, recombinant VSV particle of any one of embodiments 2-5, 9-44, immunogenic recombinant protein of any one of embodiments 6, 7, 9, 11-44, or SARS-CoV-2 vaccine of any one of embodiments 8-44, wherein the immunogenic variant of the S protein has at least one mutation relative to SEQ ID NO: 1 along the length of the immunogenic variant.

Embodiment 46 is the recombinant VSV vector of any one of embodiments 1, 9-45, recombinant VSV particle of any one of embodiments 2-5, 9-45, immunogenic recombinant protein of any one of embodiments 6, 7, 9, 11-45, or SARS-CoV-2 vaccine of any one of embodiments 8-45, wherein the immunogenic variant of the S protein comprises an S813F mutation relative to SEQ ID NO: 1.

Embodiment 47 is the recombinant VSV vector of any one of embodiments 1, 9-34, or 37-46, recombinant VSV particle of any one of embodiments 2-5, 9-34, or 37-46, immunogenic recombinant protein of any one of embodiments 6, 7, 9, 11-34, or 37-46, or SARS-CoV-2 vaccine of any one of embodiments 8-34 or 37-46, wherein the VSV-M protein comprises a Y61S mutation relative to SEQ ID NO: 1.

Embodiment 48 is the recombinant VSV vector of any one of embodiments 1 or 9-47, recombinant VSV particle of any one of embodiments 2-5 or 9-47, immunogenic recombinant protein of any one of embodiments 6, 7, 9, or 11-47, or SARS-CoV-2 vaccine of any one of embodiments 8-47, wherein the immunogenic variant of the SARS-CoV-2 S protein comprises at least one of the following mutations (either in isolation or in any combination): H655Y, R682K, R683G, N709S, S813F, N978K, S940G, D1118A, or D1163N relative to SEQ ID NO: 1.

Embodiment 49 is the recombinant VSV vector of any one of embodiments 1 or 9-48, recombinant VSV particle of any one of embodiments 2-5 or 9-48, immunogenic recombinant protein of any one of embodiments 6, 7, 9, or 11-48, or SARS-CoV-2 vaccine of any one of embodiments 8-48, wherein the immunogenic variant of the SARS-CoV-2 S protein comprises at least one mutation in SEQ ID NO: 1 chosen from F140V, Q321P, N715S, D1118A, and combinations thereof.

Embodiment 50 is the recombinant VSV vector of any one of embodiments 1 or 9-49, recombinant VSV particle of any one of embodiments 2-5 or 9-49, immunogenic recombinant protein of any one of embodiments 6, 7, 9, or 11-49, or SARS-CoV-2 vaccine of any one of embodiments 8-49, wherein the immunogenic variant of the SARS-CoV-2 S protein comprises one or more mutations relative to SEQ ID NO: 1 chosen from:
  a. H655Y, R682K, and R685G;
  b. H655Y, R682K, R685G, and a deletion of the 9 amino acids (Δ9) at the C-terminal end of the amino acid sequence of SEQ ID NO: 1;
  c. H655Y, R682K, R685G, and a deletion of the 13 amino acids (Δ13) at the C-terminal end of the amino acid sequence of SEQ ID NO: 1;
  d. Q321P, H655Y, T678I, and P812R;
  e. Q321P, H655Y, T678I, P812R, and a deletion of the 23 amino acids (Δ23) at the C-terminal end of the amino acid sequence of SEQ ID NO: 1;
  f. E154D, S115L, T678I, R685G, and M1233K;
  g. R685G, S813R, and a deletion of the 9 amino acids (Δ9) at the C-terminal end of the amino acid sequence of SEQ ID NO: 1;
  h. H655Y, R682K, and a deletion of the 13 amino acids (Δ13) at the C-terminal end of the amino acid sequence of SEQ ID NO: 1;
  i. R685G, S813F, and a deletion of the 9 amino acids (Δ9) at the C-terminal end of the amino acid sequence of SEQ ID NO: 1;

j. R683G, S813F and a deletion of the 23 amino acids (Δ23) at the C-terminal end of the amino acid sequence of SEQ ID NO: 1;
k. R683G, S813F, R685G, and a deletion of 23 amino acids (Δ23) at the C-terminal end of the amino acid sequence of SEQ ID NO: 1;
l. H655Y, P681S, R682K, and a deletion of the 13 amino acids (Δ13) at the C-terminal end of the amino acid sequence of SEQ ID NO: 1;
m. R683G and a deletion of the 23 amino acids (Δ23) at the C-terminal end of the amino acid sequence of SEQ ID NO: 1;
n. H655Y and a deletion of the 23 amino acids (Δ23) at the C-terminal end of the amino acid sequence of SEQ ID NO: 1;
o. R683G, D1118A, and a deletion of the 23 amino acids (Δ23) at the C-terminal end of the amino acid sequence of SEQ ID NO: 1;
p. R683G, N715S, and a deletion of the 23 amino acids (Δ23) at the C-terminal end of the amino acid sequence of SEQ ID NO: 1;
q. H655Y, N709S, and a deletion of the 13 amino acids (Δ13) at the C-terminal end of the amino acid sequence of SEQ ID NO: 1;
r. F140V, H655Y, and a deletion of the 23 amino acids (Δ23) at the C-terminal end of the amino acid sequence of SEQ ID NO: 1;
s. a deletion of the 21 amino acids (Δ21) at the C-terminal end of the amino acid sequence of SEQ ID NO: 1;
t. a deletion of the 19 amino acids (Δ19) at the C-terminal end of the amino acid sequence of SEQ ID NO: 1;
u. E484D, H655Y, and a deletion of 21 amino acids (Δ21) at the C-terminal end of the amino acid sequence of SEQ ID NO: 1;
v. H665Y, R685G and a deletion of the 19 amino acids (Δ19) at the C-terminal end of the amino acid sequence of SEQ ID NO: 1, wherein the SARS-CoV-2 S protein further comprises a fragment of at least 21 amino acids at the C-terminal end of a VSV-G protein;
w. D614G; or
x. D614N.

Embodiment 51 is the recombinant VSV vector of any one of embodiments 1 or 9-50, recombinant VSV particle of any one of embodiments 2-5 or 9-50, immunogenic recombinant protein of any one of embodiments 6, 7, 9, or 11-50, or SARS-CoV-2 vaccine of any one of embodiments 8-50, wherein the VSV-G protein comprises from 21 to 29 amino acids at the C-terminal end of a VSV-G protein.

Embodiment 52 is the recombinant VSV vector of any one of embodiments 1 or 9-51, recombinant VSV particle of any one of embodiments 2-5 or 9-51, immunogenic recombinant protein of any one of embodiments 6, 7, 9, or 11-51, or SARS-CoV-2 vaccine of any one of embodiments 8-51, wherein the immunogenic variant of the SARS-CoV-2 S protein is a fragment of the SARS-CoV-2 S protein that does not comprise any of the cytoplasmic tail.

Embodiment 53 is the recombinant VSV vector of any one of embodiments 1 or 9-52, recombinant VSV particle of any one of embodiments 2-5 or 9-52, immunogenic recombinant protein of any one of embodiments 6, 7, 9, or 11-52, or SARS-CoV-2 vaccine of any one of embodiments 8-52, wherein the immunogenic variant of the SARS-CoV-2 S protein is a fragment of the SARS-CoV-2 S protein lacking a transmembrane domain of the SARS-CoV-2 S protein.

Embodiment 54 is the recombinant VSV vector of any one of embodiments 1 or 9-53, recombinant VSV particle of any one of embodiments 2-5 or 9-53, immunogenic recombinant protein of any one of embodiments 6, 7, 9, or 11-53, or SARS-CoV-2 vaccine of any one of embodiments 8-53, wherein the fragment of the VSV-G gene encodes a cytoplasmic tail of a VSV-G protein.

Embodiment 55 is the recombinant VSV vector of any one of embodiments 1 or 9-54, recombinant VSV particle of any one of embodiments 2-5 or 9-54, immunogenic recombinant protein of any one of embodiments 6, 7, 9, or 11-54, or SARS-CoV-2 vaccine of any one of embodiments 8-54, wherein the fragment of the VSV-G gene encodes a transmembrane domain of a VSV-G protein.

Embodiment 56 is the recombinant VSV vector of any one of embodiments 1 or 9-55, recombinant VSV particle of any one of embodiments 2-5 or 9-55, immunogenic recombinant protein of any one of embodiments 6, 7, 9, or 11-55, or SARS-CoV-2 vaccine of any one of embodiments 8-56, wherein the at least a portion of the VSV genome comprises the VSV-N gene, VSV-P gene, VSV-M gene, and VSV-L gene arranged in sequence from 3' to 5'.

Embodiment 57 is the recombinant VSV vector of any one of embodiments 1 or 9-56, recombinant VSV particle of any one of embodiments 2-5 or 9-56, immunogenic recombinant protein of any one of embodiments 6, 7, 9, or 11-56, or SARS-CoV-2 vaccine of any one of embodiments 8-56, wherein the nucleic acid sequence encoding the SARS-COV-2 S protein or an immunogenic variant thereof is 3' of the VSV-N gene.

Embodiment 58 is the recombinant VSV vector of any one of embodiments 1 or 9-57, recombinant VSV particle of any one of embodiments 2-5 or 9-57, immunogenic recombinant protein of any one of embodiments 6, 7, 9, or 11-57, or SARS-CoV-2 vaccine of any one of embodiments 8-58, wherein the nucleic acid sequence encoding the SARS-COV-2 S protein or an immunogenic variant thereof is on the 3' end of the VSV-N gene.

Embodiment 59 is the recombinant VSV vector of any one of embodiments 1 or 9-58, recombinant VSV particle of any one of embodiments 2-5 or 9-58, immunogenic recombinant protein of any one of embodiments 6, 7, 9, or 11-58, or SARS-CoV-2 vaccine of any one of embodiments 8-58, wherein the nucleic acid sequence encoding the SARS-COV-2 S protein or an immunogenic variant thereof is between the VSV-N gene and the VSV-P gene.

Embodiment 60 is the recombinant VSV vector of any one of embodiments 1 or 9-59, recombinant VSV particle of any one of embodiments 2-5 or 9-59, immunogenic recombinant protein of any one of embodiments 6, 7, 9, or 11-59, or SARS-CoV-2 vaccine of any one of embodiments 8-59, wherein the nucleic acid sequence encoding the SARS-COV-2 S protein or an immunogenic variant thereof is between the VSV-P gene and the VSV-M gene.

Embodiment 61 is the recombinant VSV vector of any one of embodiments 1 or 9-60, recombinant VSV particle of any one of embodiments 2-5 or 9-60, immunogenic recombinant protein of any one of embodiments 6, 7, 9, or 11-60, or SARS-CoV-2 vaccine of any one of embodiments 8-60, wherein the nucleic acid sequence encoding the SARS-COV-2 S protein or an immunogenic variant thereof is between the VSV-M gene and the VSV-L gene.

Embodiment 62 is the recombinant VSV vector of any one of embodiments 1 or 9-61, recombinant VSV particle of any one of embodiments 2-5 or 9-61, immunogenic recombinant protein of any one of embodiments 6, 7, 9, or 11-61, or SARS-CoV-2 vaccine of any one of embodiments 8-61, wherein the nucleic acid sequence encoding the SARS-COV-2 S protein or an immunogenic variant thereof is 5' of the VSV-L gene.

Embodiment 63 is the recombinant VSV vector of any one of embodiments 1 or 9-62, recombinant VSV particle of any one of embodiments 2-5 or 9-62, immunogenic recombinant protein of any one of embodiments 6, 7, 9, or 11-62, or SARS-CoV-2 vaccine of any one of embodiments 8-62, wherein the nucleic acid sequence encoding the SARS-COV-2 S protein or an immunogenic variant thereof is on the 5' end of the VSV-L gene.

Embodiment 64 is the recombinant VSV vector of any one of embodiments 1 or 9-63, recombinant VSV particle of any one of embodiments 2-5 or 9-63, immunogenic recombinant protein of any one of embodiments 6, 7, 9, or 11-63, or SARS-CoV-2 vaccine of any one of embodiments 8-63, the VSV genome does not comprise a VSV-G gene or a fragment thereof.

Embodiment 65 is the SARS-CoV-2 vaccine of any one of embodiments 8-64, further comprising a pharmaceutically acceptable excipient.

Embodiment 66 is the SARS-CoV-2 vaccine of any one of any one of embodiments 8-65, wherein the SARS-CoV-2 vaccine is formulated for oral, sublingual, intramuscular, intradermal, subcutaneous, intranasal, intraocular, rectal, transdermal, mucosal (including, but not limited to buccal), topical, or parenteral administration.

Embodiment 67 is the SARS-CoV-2 vaccine of any one of any one of embodiments 8-65, wherein the SARS-CoV-2 vaccine is formulated for oral administration.

Embodiment 68 is the SARS-CoV-2 vaccine of any one of any one of embodiments 8-65, wherein the SARS-CoV-2 vaccine is formulated for intranasal administration.

Embodiment 69 is the SARS-CoV-2 vaccine of any one of any one of embodiments 8-65, wherein the SARS-CoV-2 vaccine is formulated for oral mucosal administration and intranasal administration.

Embodiment 70 is a method for producing a recombinant VSV particle, comprising a. introducing the recombinant VSV vector of any one of embodiments 1 or 9-64 into cells or infecting cells with the recombinant VSV particle of any one of embodiments 2-5 or 9-64; and
b. producing a recombinant VSV particle and optionally cells producing a recombinant S protein.

Embodiment 71 is the method of embodiment 70, wherein the recombinant VSV particle produced by the cells expresses a SARS-CoV-2 S protein or an immunogenic variant thereof on its surface.

Embodiment 72 is the method of embodiment 70 or 71, further comprising purifying the recombinant VSV particle from the cells.

Embodiment 73 is the method of any one of embodiments 70-72, further comprising purifying the SARS-CoV-2 S protein or an immunogenic variant thereof from the cells.

Embodiment 74 is the method of any one of embodiments 70-73, further comprising purifying the recombinant VSV vector from the cells.

Embodiment 75 is a recombinant cell comprising the recombinant VSV vector of any one of embodiments 1 or 9-64 or the recombinant VSV particle of any one of embodiments 2-5 or 9-64.

Embodiment 76 is the method of any one of embodiments 70-74 or the recombinant cell of embodiment 75, wherein the recombinant cell is a Vero cell.

Embodiment 77 is a method of generating an immune response against SARS-CoV-2 comprising a. administering to a subject an effective amount of the VSV vector of any one of embodiments 1 or 9-64, recombinant VSV particle of any one of embodiments 2-5 or 9-64, immunogenic recombinant protein of any one of embodiments 6, 7, 9, or 11-64, or SARS-CoV-2 vaccine of any one of embodiments 8-69; and
b. generating an immune response to SARS-CoV-2.

Embodiment 78 is the method of embodiment 77, wherein the immune response comprises a humoral response.

Embodiment 79 is the method of embodiment 77 or 78, wherein the immune response comprises a cellular antigen-specific immune response.

Embodiment 80 is the method of any one of embodiments 77-79, wherein the immune response comprises production of antibodies by the vaccinated subject that block SARS-CoV-2 infection, the method further comprising harvesting the antibodies from the vaccinated subject.

Embodiment 81 is the method of any one of embodiments 77-80, wherein the antibodies are in the form of immune serum obtained from the vaccinated subject.

Embodiment 82 is the method of any one of embodiments 77-81, wherein the antibodies are monoclonal antibodies prepared from SARS-CoV-2-specific B cells obtained from the vaccinated subject.

Embodiment 83 is the method of any one of embodiments 77-82, further comprising mixing the harvested antibodies with a pharmaceutically acceptable excipient, whereby a pharmaceutical composition is prepared.

Embodiment 84 is the method of any one of embodiments 77-83, wherein administering the recombinant VSV vector, recombinant VSV particle, immunogenic recombinant protein, or SARS-CoV-2 vaccine comprises oral, sublingual, intramuscular, intradermal, subcutaneous, intranasal, intraocular, rectal, transdermal, mucosal (including, but not limited to buccal), topical, or parenteral administration.

Embodiment 85 is the method of any one of embodiments 77-83, wherein administering the recombinant VSV vector, recombinant VSV particle, immunogenic recombinant protein, or SARS-CoV-2 vaccine comprises intranasal administration.

Embodiment 86 is the method of any one of embodiments 77-83, wherein administering the recombinant VSV vector, recombinant VSV particle, immunogenic recombinant protein, or SARS-CoV-2 vaccine comprises oral administration.

Embodiment 87 is the method of any one of embodiments 77-83, wherein administering the recombinant VSV vector, recombinant VSV particle, immunogenic recombinant protein, or SARS-CoV-2 vaccine comprises oral mucosal administration.

Embodiment 88 is the method of any one of embodiments 77-87, wherein administering occurs after the subject is exposed to SARS-CoV-2.

Embodiment 89 is the method of any one of embodiments 77-88, further comprising preventing or inhibiting binding of SARS-CoV-2 to the receptor.

Embodiment 90 is the method of any one of embodiments 77-89, wherein the subject has a pre-existing medical condition.

Embodiment 91 is the method embodiment 90, wherein the pre-existing medical condition is chosen from asthma, blood or bone marrow transplant, cancer, cardiomyopathy, cerebrovascular disease, chronic kidney disease, chronic obstructive pulmonary disease, coronary artery disease, cystic fibrosis, diabetes (including type 1 diabetes mellitus and type 2 diabetes mellitus), heart disease, heart failure, HIV, hypertension (high blood pressure), immune deficiency, immunocompromised state from solid organ transplant, liver disease, lung disease, neurologic conditions, obesity, pregnancy, pulmonary fibrosis, sickle cell disease, smoking, thalassemia, use of corticosteroids, use of immune weakening medicines, and combinations thereof.

Embodiment 92 is the method of any one of embodiments 77-91, wherein a single dose of the VSV vector, recombinant VSV particle, immunogenic recombinant protein, or SARS-CoV-2 vaccine is administered.

Embodiment 93 is the method of any one of embodiments 77-92, wherein two or more doses of the VSV vector, recombinant VSV particle, immunogenic recombinant protein, or SARS-CoV-2 vaccine is administered.

Embodiment 94 is the method of any one of embodiments 77-93, wherein the dose of the VSV vector, recombinant VSV particle, immunogenic recombinant protein, or SARS-CoV-2 vaccine ranges from $1.0\times10^6$ to $3.8\times10^8$.

Embodiment 95 is the method of any one of embodiments 77-94, wherein the dose of the VSV vector, recombinant VSV particle, immunogenic recombinant protein, or SARS-CoV-2 vaccine is $1.0\times10^6$, $3.8\times10^6$, $1.5\times10^7$, $5.6\times10^7$, or $3.8\times10^8$.

Embodiment 96 is the method of any one of embodiments 77-94, wherein the dose of the VSV vector, recombinant VSV particle, immunogenic recombinant protein, or SARS-CoV-2 vaccine is $5.0\times10^5$, $2.4\times10^6$, $1.15\times10^7$, or $5.55\times10^7$.

Embodiment 97 is the method of any one of embodiments 77-94, wherein the dose of the VSV vector, recombinant VSV particle, immunogenic recombinant protein, or SARS-CoV-2 vaccine is from $1.0\times10^6$ to $3.8\times10^8$, from $1.0\times10^6$ to $5.0\times10^7$, or from $2.0\times10^6$ to $2.0\times10^7$.

DESCRIPTION OF THE SEQUENCES

Table 1 provides a listing of certain sequences referenced herein. All sequences are written either N-to-C terminus or 5' to 3', for protein and nucleic acid sequences, respectively.

TABLE 1

Description of the Sequences

| Description | Sequences | SEQ ID NO |
|---|---|---|
| Construct 1: wt S protein amino acid sequence | Please see FIG. 1A | 1 |
| Construct 1: nucleotide sequence of wt S protein to be added to Vector A | Please see FIG. 1B | 2 |
| Construct 1: nucleotide sequence of wt S protein to be added to Vector B | Please see FIG. 1C | 3 |
| Construct 2: S protein with CT deletion | Please see FIG. 1D | 4 |
| Construct 2: nucleotide sequence of S protein with CT deletion to be added to Vector A | Please see FIG. 1E | 5 |
| Construct 2: nucleotide sequence of S protein with CT deletion to be added to Vector B | Please see FIG. 1F | 6 |
| Construct 3: S protein with VSVG-CT IND serotype | Please see FIG. 1G | 7 |
| Construct 3: nucleotide sequence of S protein with VSVG-CT IND serotype to be added to Vector A | Please see FIG. 1H | 8 |
| Construct 3: nucleotide sequence of S protein with VSVG-CT IND serotype to Vector B | Please see FIG. 1I | 9 |
| Construct 4: S protein with VSVG-TM-CT IND serotype | Please see FIG. 1J | 10 |
| Construct 4: nucleotide sequence of S protein with VSVG-TM-CT IND serotype to be added to Vector A | Please see FIG. 1K | 11 |
| Construct 4: nucleotide sequence of S protein with VSVG-TM-CT IND serotype to be added to Vector B | Please see FIG. 1L | 12 |

TABLE 1-continued

Description of the Sequences

| Description | Sequences | SEQ ID NO |
|---|---|---|
| Construct 5: S protein with MPER6aa and VSVG-TM-CT IND serotype | Please see FIG. 1M | 13 |
| Construct 5: nucleotide sequence of S protein with MPER6aa and VSVG-TM-CT IND serotype To be added to Vector A | Please see FIG. 1N | 14 |
| Construct 5: nucleotide sequence of S protein with MPER6aa and VSVG-TM-CT IND serotype To be added to Vector B | Please see FIG. 1O | 15 |
| Construct 6: S protein with dCt21 | Please see FIG. 1P | 16 |
| Construct 6: Nucleotide sequence of S protein with dCt21 to be added Vector A | Please see FIG. 1Q | 17 |
| Construct 6: Nucleotide sequence of S protein with dCt21 to be added Vector B | Please see FIG. 1R | 18 |
| Construct 7: S protein with dCt19 and VSVGct | Please see FIG. 1S | 19 |
| Construct 7: Nucleotide sequence of S protein with dCt19 and VSGct to be added Vector A | Please see FIG. 1T | 20 |
| Construct 7: Nucleotide sequence of S protein with dCt19 and VSGct to be added Vector B | Please see FIG. 1U | 21 |
| Construct 8: S protein with dCt19 and VSVGct21 | Please see FIG. 1V | 22 |
| Construct 8: Nucleotide sequence of S protein with dCt19 and VSGct21 to be added Vector A | Please see FIG. 1W | 23 |
| Construct 8: Nucleotide sequence of S protein with dCt19 and VSGct21 to be added Vector B | Please see FIG. 1X | 24 |
| gb_QHW06059 (a full-length SARS-CoV-2 S protein amino acid variant sequence) | Please see FIG. 2 | 25 |
| gb_QHZ00379 (a full-length SARS-CoV-2 S protein amino acid variant sequence) | Please see FIG. 2 | 26 |
| gb_QHR84449 (a full-length SARS-CoV-2 S protein amino acid variant sequence) | Please see FIG. 2 | 27 |
| gb_QIA20044 (a full-length SARS-CoV-2 S protein amino acid variant sequence) | Please see FIG. 2 | 28 |
| gb_QHZ00358 (a full-length SARS-CoV-2 S protein amino acid variant sequence) | Please see FIG. 2 | 29 |

TABLE 1-continued

Description of the Sequences

| Description | Sequences | SEQ ID NO |
|---|---|---|
| dbj_BCA25664 (a full-length SARS-CoV-2 S protein amino acid variant sequence) | Please see FIG. 2 | 30 |
| gb_QHZ87582 (a full-length SARS-CoV-2 S protein amino acid variant sequence) | Please see FIG. 2 | 31 |
| dbj_BCA25674 (a full-length SARS-CoV-2 S protein amino acid variant sequence) | Please see FIG. 2 | 32 |
| gb_QHZ00389 (a full-length SARS-CoV-2 S protein amino acid variant sequence) | Please see FIG. 2 | 33 |
| gb_QHZ87592 (a full-length SARS-CoV-2 S protein amino acid variant sequence) | Please see FIG. 2 | 34 |
| gb_QIB84673 (a full-length SARS-CoV-2 S protein amino acid variant sequence) | Please see FIG. 2 | 35 |
| gb_QHR63260 (a full-length SARS-CoV-2 S protein amino acid variant sequence) | Please see FIG. 2 | 36 |
| gb_QIA98606 (a full-length SARS-CoV-2 S protein amino acid variant sequence) | Please see FIG. 2 | 37 |
| gb_QIA98596 (a full-length SARS-CoV-2 S protein amino acid variant sequence) | Please see FIG. 2 | 38 |
| gb_QHR63250 (a full-length SARS-CoV-2 S protein amino acid variant sequence) | Please see FIG. 2 | 39 |
| gb_QHR63280 (a full-length SARS-CoV-2 S protein amino acid variant sequence) | Please see FIG. 2 | 40 |
| gb_QHR63290 (a full-length SARS-CoV-2 S protein amino acid variant sequence) | Please see FIG. 2 | 41 |
| gb_QHR63270 (a full-length SARS-CoV-2 S protein amino acid variant sequence) | Please see FIG. 2 | 42 |
| gb_QHZ00399 (a full-length SARS-CoV-2 S protein amino acid variant sequence) | Please see FIG. 2 | 43 |
| dbj_BCA25644 (a full-length SARS-CoV-2 S protein amino acid variant sequence) | Please see FIG. 2 | 44 |
| dbj_BCA25654 (a full-length SARS-CoV-2 S protein amino acid variant sequence) | Please see FIG. 2 | 45 |
| gb_QHO62877 (a full-length SARS-CoV-2 S protein amino acid variant sequence) | Please see FIG. 2 | 46 |
| ref_YP_00972439 (a full-length SARS-CoV-2 S protein amino acid variant sequence) | Please see FIG. 2 | 47 |

TABLE 1-continued

Description of the Sequences

| Description | Sequences | SEQ ID NO |
|---|---|---|
| gb_QHW06039 (a full-length SARS-CoV-2 S protein amino acid variant sequence) | Please see FIG. 2 | 48 |
| gb_QHO62112 (a full-length SARS-CoV-2 S protein amino acid variant sequence) | Please see FIG. 2 | 49 |
| gb_QHQ71973 (a full-length SARS-CoV-2 S protein amino acid variant sequence) | Please see FIG. 2 | 50 |
| gb_QHW06049 (a full-length SARS-CoV-2 S protein amino acid variant sequence) | Please see FIG. 2 | 51 |
| gb_QHO60594 (a full-length SARS-CoV-2 S protein amino acid variant sequence) | Please see FIG. 2 | 52 |
| gb_QHN73810 (a full-length SARS-CoV-2 S protein amino acid variant sequence) | Please see FIG. 2 | 53 |
| gb_QHO62107 (a full-length SARS-CoV-2 S protein amino acid variant sequence) | Please see FIG. 2 | 54 |
| gb_QHQ82464 (a full-length SARS-CoV-2 S protein amino acid variant sequence) | Please see FIG. 2 | 55 |
| dbj_BBW89517 (a full-length SARS-CoV-2 S protein amino acid variant sequence) | Please see FIG. 2 | 56 |
| gb_QHU79204 (a full-length SARS-CoV-2 S protein amino acid variant sequence) | Please see FIG. 2 | 57 |
| gb_QHQ71963 (a full-length SARS-CoV-2 S protein amino acid variant sequence) | Please see FIG. 2 | 58 |
| gb_QHU79194 (a full-length SARS-CoV-2 S protein amino acid variant sequence) | Please see FIG. 2 | 59 |
| gb_QHN73795 (a full-length SARS-CoV-2 S protein amino acid variant sequence) | Please see FIG. 2 | 60 |
| gb_QHU36864 (a full-length SARS-CoV-2 S protein amino acid variant sequence) | Please see FIG. 2 | 61 |
| gb_QHD43416 (a full-length SARS-CoV-2 S protein amino acid variant sequence) | Please see FIG. 2 | 62 |
| gb_QHU36854 (a full-length SARS-CoV-2 S protein amino acid variant sequence) | Please see FIG. 2 | 63 |
| gb_QHU36844 (a full-length SARS-CoV-2 S protein amino acid variant sequence) | Please see FIG. 2 | 64 |
| gb_QHU36834 (a full-length SARS-CoV-2 S protein amino acid variant sequence) | Please see FIG. 2 | 65 |

TABLE 1-continued

| Description of the Sequences | | |
|---|---|---|
| Description | Sequences | SEQ ID NO |
| gb_QHU36824 (a full-length SARS-CoV-2 S protein amino acid variant sequence) | Please see FIG. 2 | 66 |
| Consensus sequence | Please see FIG. 2 | 67 |
| 1gVSVLeader_f (primer used for the Sanger sequencing of the rVSVΔG-SARS-CoV-2 genome) | ACGAAGACAAACAAACCATTATTATCATTAAAAGG | 68 |
| 2gVSV_400f (primer used for the Sanger sequencing of the rVSVΔG-SARS-CoV-2 genome) | AGCAGGGGATACAATCGGAATA | 69 |
| 3gVSV_800f (primer used for the Sanger sequencing of the rVSVΔG-SARS-CoV-2 genome) | CACCTCTGCAAAATAACCGGAA | 70 |
| 4gVSV_1200f (primer used for the Sanger sequencing of the rVSVΔG-SARS-CoV-2 genome) | GCAGAGATGTGGTCGAATGGC | 71 |
| 5gVSV_1600f (primer used for the Sanger sequencing of the rVSVΔG-SARS-CoV-2 genome) | TGAAGGCTTTATACAGGGGC | 72 |
| 6gVSV_200r (primer used for the Sanger sequencing of the rVSVΔG-SARS-CoV-2 genome) | TGGTAGACATATCCTCTTAG | 73 |
| 7gVSV_400r (primer used for the Sanger sequencing of the rVSVΔG-SARS-CoV-2 genome) | GCTGGTTCTGGAAGCATCCG | 74 |
| 8gVSV_800r (primer used for the Sanger sequencing of the rVSVΔG-SARS-CoV-2 genome) | CTGGAAGCATCATTTGGACCATTT | 75 |
| 9gVSV_1200r (primer used for the Sanger sequencing of the rVSVΔG-SARS-CoV-2 genome) | GCTCTTTTCGCATACTGCATCATA | 76 |
| 10gVSV_1600r (primer used for the Sanger sequencing of the rVSVΔG-SARS-CoV-2 genome) | CCACTTCCTCATCTGCATAGTCAT | 77 |
| 11gVSV_1200f (primer used for the Sanger sequencing of the rVSVΔG-SARS-CoV-2 genome) | GCAGAGATGTGGTCGAATGGC | 78 |
| 12gVSV_1600f (primer used for the Sanger sequencing of the rVSVΔG-SARS-CoV-2 genome) | TGAAGGCTTTATACAGGGGC | 79 |
| 13gVSV_2000f (primer used for the Sanger sequencing of the rVSVΔG-SARS-CoV-2 genome) | TCCATGACTTTCCAACCCAAGA | 80 |
| 14gVSV_2400f (primer used for the Sanger sequencing of the rVSVΔG-SARS-CoV-2 genome) | CGAGATGGACACCTATGATCCGAA | 81 |
| 15gVSV_1200r (primer used for the Sanger sequencing of the rVSVΔG-SARS-CoV-2 genome) | GCTCTTTTCGCATACTGCATCATA | 82 |
| 16gVSV_1600r (primer used for the Sanger sequencing of the rVSVΔG-SARS-CoV-2 genome) | CCACTTCCTCATCTGCATAGTCAT | 83 |

TABLE 1-continued

| Description of the Sequences | | |
|---|---|---|
| Description | Sequences | SEQ ID NO |
| 17gVSV_2000r (primer used for the Sanger sequencing of the rVSVΔG-SARS-CoV-2 genome) | CTCCGACAGAGATGAACTCTCCTC | 84 |
| 18gVSV_2400r (primer used for the Sanger sequencing of the rVSVΔG-SARS-CoV-2 genome) | GCTGCCACATCTGAGTATGTTCTG | 85 |
| 19gVSV_2000f (primer used for the Sanger sequencing of the rVSVΔG-SARS-CoV-2 genome) | TCCATGACTTTCCAACCCAAGA | 86 |
| 20gVSV_2400f (primer used for the Sanger sequencing of the rVSVΔG-SARS-CoV-2 genome) | CGAGATGGACACCTATGATCCGAA | 87 |
| 21gVSV_2800f2 (primer used for the Sanger sequencing of the rVSVΔG-SARS-CoV-2 genome) | CTACGATGATGAGTCACTGG | 88 |
| 22gVSV_2400r (primer used for the Sanger sequencing of the rVSVΔG-SARS-CoV-2 genome) | GCTGCCACATCTGAGTATGTTCTG | 89 |
| 23gVSV_2800r (primer used for the Sanger sequencing of the rVSVΔG-SARS-CoV-2 genome) | CCTTTTTCTCGACAATCAGGCC | 90 |
| 24CoV_S_rvs1 (primer used for the Sanger sequencing of the rVSVΔG-SARS-CoV-2 genome) | CTCTTTGTTCCATTGGTTCC | 91 |
| 25gVSV_2400f (primer used for the Sanger sequencing of the rVSVΔG-SARS-CoV-2 genome) | CGAGATGGACACCTATGATCCGAA | 92 |
| 26CoV_S_fw1 (primer used for the Sanger sequencing of the rVSVΔG-SARS-CoV-2 genome) | AGTGGATCCTACTCGAGAGG | 93 |
| 27CoV_S_fw2 (primer used for the Sanger sequencing of the rVSVΔG-SARS-CoV-2 genome) | CATTAAAGTCTGTGAATTCC | 94 |
| 28CoV_S_fw3 (primer used for the Sanger sequencing of the rVSVΔG-SARS-CoV-2 genome) | AGCAGCTGCTTACTATGTTG | 95 |
| 29CoV_S_fw4 (primer used for the Sanger sequencing of the rVSVΔG-SARS-CoV-2 genome) | GTATATGCAGATTCCTTTGT | 96 |
| 30CoV_S_fw5 (primer used for the Sanger sequencing of the rVSVΔG-SARS-CoV-2 genome) | ACCTAAGAAGAGCACTAATCT | 97 |
| 31CoV_S_rvs1 (primer used for the Sanger sequencing of the rVSVΔG-SARS-CoV-2 genome) | CTCTTTGTTCCATTGGTTCC | 98 |
| 32CoV_S_rvs2 (primer used for the Sanger sequencing of the rVSVΔG-SARS-CoV-2 genome) | GATCTCTAACTAGGTTTATAGGTGT | 99 |
| 33CoV_S_rvs3 (primer used for the Sanger sequencing of the rVSVΔG-SARS-CoV-2 genome) | AGTAGCATTGAAAACCTCTC | 100 |
| 34CoV_S_rvs4 (primer used for the Sanger sequencing of the rVSVΔG-SARS-CoV-2 genome) | CATTACACGGTGTGCTGCCC | 101 |

TABLE 1-continued

| Description of the Sequences | | |
|---|---|---|
| Description | Sequences | SEQ ID NO |
| 35CoV_S_rvs5 (primer used for the Sanger sequencing of the rVSVΔG-SARS-CoV-2 genome) | GATAGAGAACGGCAACTTGA | 102 |
| 36CoV_S_rvs6 (primer used for the Sanger sequencing of the rVSVΔG-SARS-CoV-2 genome) | GGAATCTCCACAGATGTACA | 103 |
| 37CoV_S_fw5 (primer used for the Sanger sequencing of the rVSVΔG-SARS-CoV-2 genome) | ACCTAAGAAGAGCACTAATCT | 104 |
| 38CoV_S_fw6 (primer used for the Sanger sequencing of the rVSVΔG-SARS-CoV-2 genome) | TGACATTCCAATCGGTGCCG | 105 |
| 39CoV_S_fw7 (primer used for the Sanger sequencing of the rVSVΔG-SARS-CoV-2 genome) | CCATCAAGGATTTTGGAGGATTTAA | 106 |
| 40CoV_S_fw8 (primer used for the Sanger sequencing of the rVSVΔG-SARS-CoV-2 genome) | GCTATAGGAAAGATTCAGGA | 107 |
| 41CoV_S_fw9 (primer used for the Sanger sequencing of the rVSVΔG-SARS-CoV-2 genome) | ACATGTAACATATGTGCCCG | 108 |
| 42CoV_S_fw10 (primer used for the Sanger sequencing of the rVSVΔG-SARS-CoV-2 genome) | TGATCGACCTTCAGGAGCTG | 109 |
| 43CoV_S_rvs7 (primer used for the Sanger sequencing of the rVSVΔG-SARS-CoV-2 genome) | TGTAATTGTACCAGCCAACA | 110 |
| 44CoV_S_rvs8 (primer used for the Sanger sequencing of the rVSVΔG-SARS-CoV-2 genome) | TGATGAGTTGTTGGGTGACG | 111 |
| 45CoV_S_rvs9 (primer used for the Sanger sequencing of the rVSVΔG-SARS-CoV-2 genome) | GGAATCGAGTTCAGGTTGTA | 112 |
| 46CoV_S_rvs10 (primer used for the Sanger sequencing of the rVSVΔG-SARS-CoV-2 genome) | AACGCGTAAACAGCTAGCCT | 113 |
| 47gVSVGene4_f (primer used for the Sanger sequencing of the rVSVΔG-SARS-CoV-2 genome) | TTAATGTTTGGCCTGATTGTCGAGA | 114 |
| 48gVSVGene4_rev (primer used for the Sanger sequencing of the rVSVΔG-SARS-CoV-2 genome) | GCGCTCATCGGGATTCAGGAA | 115 |
| 49gVSV_4800r (primer used for the Sanger sequencing of the rVSVΔG-SARS-CoV-2 genome) | CCACCACGTCAAATGTTATTTC | 116 |
| 50CoV_S_fw10 (primer used for the Sanger sequencing of the rVSVΔG-SARS-CoV-2 genome) | ACATGTAACATATGTGCCCG | 117 |
| 51gVSV_5300f (primer used for the Sanger sequencing of the rVSVΔG-SARS-CoV-2 genome) | GGGCAACAAACCAATTGAAT | 118 |
| 52gVSV_5800f (primer used for the Sanger sequencing of the rVSVΔG-SARS-CoV-2 genome) | GCAAGAGAATCAAGGCCTTTAGT | 119 |

TABLE 1-continued

| Description of the Sequences | | |
|---|---|---|
| Description | Sequences | SEQ ID NO |
| 53gVSV_6300f (primer used for the Sanger sequencing of the rVSVΔG-SARS-CoV-2 genome) | CCCATCGATAATATACTCTGACAAA | 120 |
| 54gVSV_6800f (primer used for the Sanger sequencing of the rVSVΔG-SARS-CoV-2 genome) | TCCTTAATCGAGAGAACTCATGAA | 121 |
| 55gVSV_4800r (primer used for the Sanger sequencing of the rVSVΔG-SARS-CoV-2 genome) | CCACCACGTCAAATGTTATTTC | 122 |
| 56gVSV_5200r2 (primer used for the Sanger sequencing of the rVSVΔG-SARS-CoV-2 genome) | ACTAAAGGCCTTGATTCTCTTGC | 123 |
| 57gVSV_5200r (primer used for the Sanger sequencing of the rVSVΔG-SARS-CoV-2 genome) | GATGGGTCTAGTAAGTCGGGTATT | 124 |
| 58gVSV_6200r2 (primer used for the Sanger sequencing of the rVSVΔG-SARS-CoV-2 genome) | TTCATGAGTTCTCTCGATTAAGGA | 125 |
| 59gVSV_6200r (primer used for the Sanger sequencing of the rVSVΔG-SARS-CoV-2 genome) | CACTCGTGACCATCTCTTGG | 126 |
| 60gVSV_6300f (primer used for the Sanger sequencing of the rVSVΔG-SARS-CoV-2 genome) | CCCATCGATAATATACTCTGACAAA | 127 |
| 61gVSV_6800f (primer used for the Sanger sequencing of the rVSVΔG-SARS-CoV-2 genome) | TCCTTAATCGAGAGAACTCATGAA | 128 |
| 62gVSV_7300f (primer used for the Sanger sequencing of the rVSVΔG-SARS-CoV-2 genome) | TGACCAAATACCCACTTGTGC | 129 |
| 63gVSV_7800f (primer used for the Sanger sequencing of the rVSVΔG-SARS-CoV-2 genome) | CGAACTTGTTAAAGACTGAGGTTAA | 130 |
| 64JKgVSV_8300f (primer used for the Sanger sequencing of the rVSVΔG-SARS-CoV-2 genome) | CGGGATCCATGACGTCTTTA | 131 |
| 65gVSV_8800f (primer used for the Sanger sequencing of the rVSVΔG-SARS-CoV-2 genome) | TTTGAGACCCATAGAAGAGATCAC | 132 |
| 66gVSV_6200r (primer used for the Sanger sequencing of the rVSVΔG-SARS-CoV-2 genome) | CACTCGTGACCATCTCTTGG | 133 |
| 67gVSV_7200r2 (primer used for the Sanger sequencing of the rVSVΔG-SARS-CoV-2 genome) | TTAACCTCAGTCTTTAACAAGTTCG | 134 |
| 68gVSV_7200r (primer used for the Sanger sequencing of the rVSVΔG-SARS-CoV-2 genome) | TGAACCCTGATGTGTTACATGG | 135 |
| 69gVSV_8200r2 (primer used for the Sanger sequencing of the rVSVΔG-SARS-CoV-2 genome) | GTGATCTCTTCTATGGGTCTCAAA | 136 |

TABLE 1-continued

Description of the Sequences

| Description | Sequences | SEQ ID NO |
|---|---|---|
| 70gVSV_8200r (primer used for the Sanger sequencing of the rVSVΔG-SARS-CoV-2 genome) | TCGTTTCTAATTCGTCTCTAATAGG | 137 |
| 71gVSV_8300f (primer used for the Sanger sequencing of the rVSVΔG-SARS-CoV-2 genome) | CGGGATCCATGACGTCTTTA | 138 |
| 72gVSV_8800f (primer used for the Sanger sequencing of the rVSVΔG-SARS-CoV-2 genome) | TTTGAGACCCATAGAAGAGATCAC | 139 |
| 73gVSV_9300f (primer used for the Sanger sequencing of the rVSVΔG-SARS-CoV-2 genome) | CTCCTATCCGACAAGCAACC | 140 |
| 74gVSV_9800f (primer used for the Sanger sequencing of the rVSVΔG-SARS-CoV-2 genome) | GAATCAGGTTGGGCCAATTA | 141 |
| 75gVSV_10300f (primer used for the Sanger sequencing of the rVSVΔG-SARS-CoV-2 genome) | GAGCGAAAAGAATGCAGTAACA | 142 |
| 76gVSV_10800f (primer used for the Sanger sequencing of the rVSVΔG-SARS-CoV-2 genome) | GCTTTTGGCTGAGTTTGATG | 143 |
| 77JKVSVGene6_f (primer used for the Sanger sequencing of the rVSVΔG-SARS-CoV-2 genome) | AAACACAGGAATGATTGAAT | 144 |
| 78gVSV_8200r (primer used for the Sanger sequencing of the rVSVΔG-SARS-CoV-2 genome) | TCGTTTCTAATTCGTCTCTAATAGG | 145 |
| 79gVSV_9200r2 (primer used for the Sanger sequencing of the rVSVΔG-SARS-CoV-2 genome) | TAATTGGCCCAACCTGATTC | 146 |
| 80gVSV_9200r (primer used for the Sanger sequencing of the rVSVΔG-SARS-CoV-2 genome) | CGCTCTCACAAATATATGTTCCATA | 147 |
| 81gVSV_10200r2 (primer used for the Sanger sequencing of the rVSVΔG-SARS-CoV-2 genome) | CATCAAACTCAGCCAAAAGC | 148 |
| 82JRVSVTrailer_r (primer used for the Sanger sequencing of the rVSVΔG-SARS-CoV-2 genome) | ACGAAGACCACAAAACCAGATAAA | 149 |
| Nucleotide sequence for rVSVΔG-SARS-CoV-2 clone MB1 | 1 acgaagacaa acaaaccatt attatcatta aaaggctcag gagaaacttt aacagtaatc<br>61 aaaatgtctg ttacagtcaa gagaatcatt gacaacacag tcgtagttcc aaaacttcct<br>121 gcaaatgagg atccagtgga atacccggca gattacttca gaaaatcaaa ggagattcct<br>181 ctttacatca atactacaaa aagtttgtca gatctaagag gatatgtcta ccaaggcctc<br>241 aaatccggaa atgtatcaat catacatgtc aacagctact tgtatggagc attaaaggac<br>301 atccggggta agttggataa agattggtca agtttcggaa taaacatcgg gaaagcaggg<br>361 gatacaatcg gaatatttga ccttgtatcc ttgaaagccc tggacggcgt acttccagat<br>421 ggagtatcgg atgcttccag aaccagcgca gatgacaaat ggttgccttt gtatctactt<br>481 ggcttataca gagtgggcag aacacaaatg cctgaataca gaaaaaagct catggatggg<br>541 ctgacaaatc aatgcaaaat gatcaatgaa cagtttgaac ctcttgtgcc agaaggtcgt<br>601 gacttttttg atgtgtgggg aaatgacagt aattacacaa aaattgtcgc tgcagtggac<br>661 atgttcttcc acatgttcaa aaaacatgaa tgtgcctcgt tcagatacgg aactattgtt<br>721 tccagattca agattgtgtg tgcattggca acatttggac acctctgcaa ataaccgga<br>781 atgtctacag aagatgtaac gacctggatc ttgaaccgag aagttgcaga tgaaatggtc<br>841 caaatgatgc ttccaggcca agaaattgac aaggccgatt catacatgcc ttatttgatc | 150 |

TABLE 1-continued

Description of the Sequences

| Description | Sequences | SEQ ID NO |
|---|---|---|
| | 901 gactttggat tgtcttctaa gtctccatat tcttccgtca aaaaccctgc cttccacttc | |
| | 961 tggggcaat tgacagctct tctgctcaga tccaccagag caaggaatgc ccgacagcct | |
| | 1021 gatgacattg agtatacatc tcttactaca gcaggtttgt tgtacgctta tgcagtagga | |
| | 1081 tcctctgccg acttggcaca acagttttgt gttggagata acaaatacac tccagatgat | |
| | 1141 agtaccgag gattgacgac taatgcaccg ccacaaggca gagatgtggt cgaatggctc | |
| | 1201 ggatggtttg aagatcaaaa cagaaaaccg actcctgata tgatgcagta tgcgaaaaga | |
| | 1261 gcagtcatgt cactgcaagg cctaagagag aagacaattg gcaagtatgc taagtcagaa | |
| | 1321 tttgacaaat gaccctataa ttctcagatc acctattata tattatgcta catatgaaaa | |
| | 1381 aaactaacag atatcatgga taatctcaca aaagttcgtg agtatctcaa gtcctattct | |
| | 1441 cgtctggatc aggcggtagg agagatagat gagatcgaag cacaacgagc tgaaaagtcc | |
| | 1501 aattatgagt tgttccaaga ggatggagtg gaagagcata ctaagccctc ttattttcag | |
| | 1561 gcagcagatg attctgacac agaatctgaa ccagaaattg aagacaatca aggcttgtat | |
| | 1621 gcaccagatc cagaagctga gcaagttgaa ggctttatac aggggccttt agatgactat | |
| | 1681 gcagatgagg aagtggatgt tgtatttact tcggactgga acagcctga gcttgaatct | |
| | 1741 gacgagcatg gaaagacctt acggttgaca tcgccagagg gtttaagtgg agagcagaaa | |
| | 1801 tcccagtggc tttcgacgat taaagcagtc gtgcaaagtg ccaaatactg gaatctggca | |
| | 1861 gagtgcacat ttgaagcatc gggagaaggg gtcattatga aggagcgcca gataactccg | |
| | 1921 gatgtatata aggtcactcc agtgatgaac acacatccgt cccaatcaga agcagtatca | |
| | 1981 gatgtttggt ctctctcaaa gacatccatg acttttccaac ccaagaaagc aagtcttcag | |
| | 2041 cctctcacca tatccttgga tgaattgttc tcatctagag gagagttcat ctctgtcgga | |
| | 2101 ggtgacggac gaatgtctca taaagaggcc atcctgctcg gcctgagata caaaaagttg | |
| | 2161 tacaatcagg cgagagtcaa atattctctg tagactatga aaaaagtaa cagatatcac | |
| | 2221 gatctcaagt tatcccaat ccattcatca tgagttcctt aaagaagatt ctcggtctga | |
| | 2281 aggggaaagg taagaaatct aagaaattag ggatcgcacc accccttat gaagaggaca | |
| | 2341 ctagcatgga gtatgctccg agcgctccaa ttgacaaatc ctattttgga gttgacgaga | |
| | 2401 tggacaccta tgatccgaat caattaagat ctgagaaatt cttcttaca gtgaaaatga | |
| | 2461 cggttagatc taatcgtccg ttcagaacat actcagatgt ggcagccgct gtatcccatt | |
| | 2521 gggatcacat gtacatcgga atggcaggga aacgtccctt ctacaaaatc ttggcttttt | |
| | 2581 tgggttcttc taatctaaag gccactccag cggtattggc agataccggt caaccagagt | |
| | 2641 atcacgctca ctgcgaaggc agggcttatt tgccacatag gatgggggaag accctccca | |
| | 2701 tgctcaatgt accagagcac ttcagaagac cattcaatat aggtctttac aagggaacga | |
| | 2761 ttgagctcac aatgaccatc tacgatgatg agtcactgga agcagctcct atgatctggg | |
| | 2821 atcatttcaa ttcttccaaa ttttctgatt tcagagagaa ggccttaatg tttggcctga | |
| | 2881 ttgtcgagaa aaaggcatct ggagcgtggg tcctggactc tatcggccac ttcaaatgag | |
| | 2941 ctagtctaac ttctagcttc tgaacaatcc ccggtttact cagtctcccc taattccagc | |
| | 3001 ctctcgaaca actaatatcc tgtcttttct atccctatga aaaaactaa cagagattga | |
| | 3061 tctgtttacg cgctagtgga tcctactcga gaggagccac catgttcgtg ttcctggtgc | |
| | 3121 tattacctct ggtttcgtct caatgcgtaa accttacaac tagaactcag cttcctccag | |
| | 3181 catacacaaa ttccttcact cgcggagtgt attatcctga taaggtcttt cgatcatcag | |
| | 3241 tgttgcattc cacccaggat ttgtttctcc cgttctttc aaatgtaact tggttccatg | |
| | 3301 ctatacatgt ttccggaacc aatggaacaa agagattga taacccagtg ttaccattta | |
| | 3361 acgacggagt ttatttcgca tcaactgaga aatccaatat cattagaggc tggattttcg | |
| | 3421 gaacgaccct ggattctaaa acgcaatcct tgctgattgt taataatgca acaaatgtgg | |
| | 3481 tcattaaagt ctgtgaattc caattttgca atgatccatt tctcggcgtc tattaccaca | |
| | 3541 agaataacaa atcttggatg gagtcagagt tcagggttta tagttccgca aataattgta | |
| | 3601 cttttgaata cgtttcccaa ccattcttaa tggacttgga gggaaaacag ggaaatttta | |
| | 3661 agaatctaag agaattcgtc tttaagaata ttgatggata tttcaagatc tattcaaaac | |
| | 3721 atacacctat aaacctagtt agagatctcc cgcaagggtt ttcagcccta gagccactag | |
| | 3781 ttgacctgcc aattgggatc aacattacta gattccagac cctactcgct ctgcatcggt | |
| | 3841 catatttgac accaggagat tcatcgtcag gatggaccgc tggagcagct gcttactatg | |
| | 3901 ttgggtatct gcaacctaga acatttctcc taaagtataa tgaaaacggg actattacag | |
| | 3961 acgcagtcga ttgcgcactg gatccactct cagagacaaa gtgcactcta aaatcattca | |
| | 4021 ctgtcgagaa aggaatctat caaacatcaa atttcagggt ccagccaact gagagtattg | |
| | 4081 tccggttccc taacataact aacttgtgcc ccttcggaga ggttttcaat gctactcggt | |
| | 4141 tcgccagcgt ctacgcatgg aacagaaaga ggatttcaaa ctgtgtcgca gattatagcg | |
| | 4201 tcctctataa ttcagcatca ttcagtacat taaatgcta tggtgtcagc cccaccaaac | |
| | 4261 ttaatgactt atgttttacc aatgtatatg cagattcctt tgtaatcaga ggtgacgaag | |
| | 4321 tgaggcaaat cgcacctgga cagaccggaa agattgctga ttataattat aaactccctg | |
| | 4381 atgatttac cggatgtgtt attgcttgga acagcaataa cctcgatagt aaggtcggag | |
| | 4441 gaaactataa ctatttgtac agactgttta aaagtcgaa tttgaaacct tttgaaagag | |
| | 4501 acatatccac cgagatttac caggcgggca gcacaccgtg taatggtgta gaaggattca | |
| | 4561 attgttactt tcccctgcaa tcatatgggt ttcaaccaac caatggagtc ggatatcaac | |
| | 4621 catatcgtgt cgtcgtcctt ccttcgagc tgcttcatgc accagctaca gtctgcggac | |
| | 4681 ctaagaagag cactaatctt gtcaagaaca aatgtgtgaa ctttaatttt aatggattaa | |
| | 4741 caggaaccgg agttttgacc gagagtaata agaagttcct gccgttccag caatttggac | |
| | 4801 gagacattgc tgacaccaca gatgcggttc gtgacccgca aactttagag atcctagaca | |
| | 4861 tcaccccatg ttcattcggt ggagtttccg ttattactcc tggaacgaat acaagcaatc | |
| | 4921 aagttgccgt tctctatcaa gatgttaatt gtacagaagt gcctgtggcc attcatgcag | |
| | 4981 atcaactaac accaacttgg agagtttaca gcactggtgtc caatgtctcc caaacgcgcg | |
| | 5041 ccggctgcct cattggtgca gaacatgtga ataactcata cgaatgtgac attccaatcg | |
| | 5101 gtgccggcat atgcgcctct taccagactc agactaattc gccaagagga gccaggtctg | |
| | 5161 tcgcaagtca gtcaattatt gcatacacaa tgtcgttagg agcagagaat agtgtagcat | |
| | 5221 actcaaacaa ttctatagca ataccaccaa acttcactat atcagtaact acagaaatat | |
| | 5281 tgccagtatc catgactaaa acaagtgtgg attgcaccat gtacatctgt ggagattcca | |

TABLE 1-continued

Description of the Sequences

| Description | Sequences | SEQ ID NO |
|---|---|---|
| | 5341 cagaatgcag caatcttctc ttgcaatacg gatcattctg cacacaactg aatagggcac | |
| | 5401 tgactggaat tgcagtcgag caggataaga acacacagga ggtgtttgcc caagtcaaac | |
| | 5461 aaatatacaa aacaccaccc atcaaggatt ttgaggatt taatttctca caaatactcc | |
| | 5521 ccgacccatc caagcccttc aaaaggagtt tcattgagga cctcttgttt aataaggtta | |
| | 5581 ccttggcaga tgccgggttt attaagcagt acggcgactg tcttggagac atagcagcca | |
| | 5641 gagatctaat ttgtgcccag aaattcaatg gactgacagt cctgcctccc ttattaactg | |
| | 5701 atgagatgat agctcagtat acatcagcat tgttggctgg tacaattaca tctggatgga | |
| | 5761 cattggtgc cggagcggca ttacaaatcc cttttgcaat gcaaatggcc tatagattta | |
| | 5821 atggaatcgg agtaactcaa aatgttttat atgagaatca gaaattaatt gcaaatcaat | |
| | 5881 tcaattcagc tataggaaag attcaggatt cactcagtag tacagcaagc gctctaggca | |
| | 5941 aattacaaga cgtcgtcaat cagaatgcac aggcattaaa tacactggtg aagcaattga | |
| | 6001 gttccaattt cggagcaatt tcatctgttc taaatgatat attgtcaaga ctggataaag | |
| | 6061 tagaagccga ggtccaaatc gataggctga tcacaggaag acttcaatca ctacagacat | |
| | 6121 acgtcaccca acaactcatc agagcagcag aaattagagc ctctgctaat ctagccgcaa | |
| | 6181 caaagatgtc agagtgcgta ttgggacaat ctaagagggt cgacttttgt ggaaagggt | |
| | 6241 atcacttgat gtcctttcct caatctgcac cacacggagt tgtcttctta catgtaacat | |
| | 6301 atgtgcccgc tcaagaaaag aatttcacta cagcacctgc aatatgtcat gacggaaaag | |
| | 6361 cacattttcc tcgggaggga gttttcgttt ctaatggaac ccattggttc gtgacccaaa | |
| | 6421 ggaactttta cgagcctcaa ataattacaa ctgataatac attcgtttct ggaaattgcg | |
| | 6481 acgtagttat aggtattgta aataatactg tttatgaccc tttacaacct gaactcgatt | |
| | 6541 ccttcaagga agaactcgac aaatatttta agaatcacac ctcaccggac gttgacttag | |
| | 6601 gagacatttc cgggattaac gctagtgtag tcaatatcca aaaggagata gatagactga | |
| | 6661 atgaggtagc aaagaatctt aatgaatctt tgatcgacct tcaggagctg gggaagtacg | |
| | 6721 aacaatacat aaaatggcca tggtacattt ggctcgggtt tattgctgga ctaattgcaa | |
| | 6781 tagtcatggt cactatcatg ctgtgttgta tgacatcgtg ctgctcatgc ctcaagggat | |
| | 6841 gttgtagctg ttgatcttgt tgcaagttcg atgaggatga ttcagaacca gttttaaaag | |
| | 6901 gagtaaagtt gcattacaca taaaggctag ctgtttacgc gttatccatg ctcaaagagg | |
| | 6961 cctcaattat atttgagttt ttaattttta tgaaaaaaac taacagcaat catggaagtc | |
| | 7021 cacgattttg agaccgacga gttcaatgat ttcaatgaag atgactatgc cacaagagaa | |
| | 7081 ttcctgaatc ccgatgagcg catgacgtac ttgaatcatg ctgattacaa cctgaattct | |
| | 7141 cctctaatta gtgatgatat tgacaattta atcaggaaat tcaattctct tccaattccc | |
| | 7201 tcgatgtggg atagtaagaa ctgggatgga gttcttgaga tgttaacgtc atgtcaagcc | |
| | 7261 aatcccatcc caacatctca gatgcataaa tggatggaa gttggttaat gtctgataat | |
| | 7321 catgatgcca gtcaagggta tagttttta catgaagtgg acaaagaggc agaaataaca | |
| | 7381 tttgacgtgg tggagacctt catccgcggc tggggcaaca aaccaattga atacatcaaa | |
| | 7441 aaggaaagat ggactgactc attcaaaatt ctcgcttatt tgtgtcaaaa gttttggac | |
| | 7501 ttacacaagt tgacattaat cttaaatgct gtctctgagg tggaattgct caacttggcg | |
| | 7561 aggactttca aaggcaaagt cagaagaagt tctcatgaaa cgaacatatg caggattagg | |
| | 7621 gttcccagct tgggtcctac ttttatttca gaaggatggg cttacttcaa gaaacttgat | |
| | 7681 attctaatgt accgaaactt tctgttaatg gtcaaagatg tgattatagg gaggatgcaa | |
| | 7741 acggtgctat ccatggtatg tagaatagac aacctgttct cagagcaaga catccttctcc | |
| | 7801 cttctaaata tctacagaat tggagataaa attgtggaga ggcagggaaa ttttttcttat | |
| | 7861 gacttgatta aaatggtgga accgatatgc aacttgaagc tgatgaaatt agcaagagaa | |
| | 7921 tcaaggcctt tagtcccaca attccctcat tttgaaaatc atatcaagac ttctgttgat | |
| | 7981 gaaggggcaa aaattgaccg aggtataaga ttcctccatg atcagataat gagtgtgaaa | |
| | 8041 acagtggatc tcacactggt gatttatgga tcgttcagac attgggtca tccttttata | |
| | 8101 gattattaca ctggactaga aaaattacat tcccaagtaa ccatgaagaa agatattgat | |
| | 8161 gtgtcatatg caaaagcact tgcaagtgat ttagctcgaa ttgttctatt tcaacagttc | |
| | 8221 aatgatcata aaagtggtt cgtgaatgga gacttgctcc ctcatgatca tccctttaaa | |
| | 8281 agtcatgtta aagaaaatac atgcccaca gctgctcaag ttcaagattt tggagataaa | |
| | 8341 tggcatgaac ttccgctgat taaatgtttt gaaataccg acttactaga cccatcgata | |
| | 8401 atatactctg acaaaagtca ttcaatgaat aggtcagagg tgttgaaaca tgtccgaatg | |
| | 8461 aatccgaaca ctcctatccc tagtaaaaag gtgttgcaa ctatgttgga cacaaaggct | |
| | 8521 accaattgga agaatttct taaagagatt gatgagaagg gcttagatga tgatgatcta | |
| | 8581 attattggtc ttaaaggaaa ggagaggaa ctgaagttgg caggtagatt tttctcccta | |
| | 8641 atgtcttgga aattgcgaga atactttgta attaccgaat atttgataaa gactcatttc | |
| | 8701 gtccctatgt ttaaaggcct gacaatggcg gacgatctaa ctgcagtcat taaaaagatg | |
| | 8761 ttagattcct catccgccc aggattgaag tcatatgagg caatttgcat agccaatcac | |
| | 8821 attgattacg aaaaatggaa taaccaccaa ggaagttat caaacggccc agtgttccga | |
| | 8881 gttatgggcc agttcttagg ttatccatcc ttaatcgaga gaactcatga atttttgag | |
| | 8941 aaaagtctta tactacaa tggaagacca gacttgatgc gtgttcacaa caacacactg | |
| | 9001 atcaattcaa cctcccaacg agtttgttgg caaggacaag agggtggact ggaaggtcta | |
| | 9061 cggcaaaaag gatggagtat cctcaatcta ctggttattc aaagagaggc taaaatcaga | |
| | 9121 aacactgctg tcaaagtctt ggcacaaggt gataatcaag ttatttgcac acagtataaa | |
| | 9181 acgaagaaat cgagaaacgt tgtagaatta cagggtgctc tcaatcaaat ggtttctaat | |
| | 9241 aatgagaaaa ttatgactgc aatcaaaata gggacaggga agttaggact tttgataaat | |
| | 9301 gacgatgaga ctatgcaatc tgcagattac ttgaattatg gaaaatacc gatttccgt | |
| | 9361 ggagtgatta gagggttaga gaccaagaga tggtcacgag tgacttgtgt caccaatgac | |
| | 9421 caaatacca cttgtgctaa tataatgaac tcagtttcca caaatgctct caccgtagct | |
| | 9481 catttttgctg agaacccaat caatgccatg atacagtaca attatttggg acatttgct | |
| | 9541 agactcttgt tgatgatgca tgatcctgct cttcgtcaat cattgtatga agttcaagat | |
| | 9601 aagataccag gcttgcacag ttctacttc aaatacgcca tgttgtattt ggaccttcc | |
| | 9661 attggaggag tgtcgggcat gtctttgtcc aggttttga ttagagcctt cccagatccc | |
| | 9721 gtaacagaaa gtctctcatt ctggagattc atccatgtac atgctcgaag tgagcatctg | |

TABLE 1-continued

Description of the Sequences

| Description | Sequences | SEQ ID NO |
|---|---|---|
| | 9781 aaggagatga gtgcagtatt tggaaacccc gagatagcca agtttcgaat aactcacata<br>9841 gacaagctag tagaagatcc aacctctctg aacatcgcta tgggaatgag tccagcgaac<br>9901 ttgttaaaga ctgaggttaa aaaatgctta atcgaatcaa gacaaaccat caggaaccag<br>9961 gtgattaagg atgcaaccat atatttgtat catgaagagg atcggctcag aagtttctta<br>10021 tggtcaataa atcctctgtt ccctagattt ttaagtgaat tcaaatcagg cacttttttg<br>10081 ggagtcgcag acgggctcat cagtctattt caaaattctc gtactattcg gaactccttt<br>10141 aagaaaaagt atcataggga attggatgat ttgattgtga ggagtgaggt atcctctttg<br>10201 acacatttag ggaaacttca tttgagaagg ggatcatgta aaatgtggac atgttcagct<br>10261 actcatgctg acacattaag atacaaatcc tggggccgta cagttattgg gacaactgta<br>10321 ccccatccat tagaaatgtt gggtccacaa catcgaaaag agactccttg tgcaccatgt<br>10381 aacacatcag ggttcaatta tgtttctgtg cattgtccag acgggatcca tgacgtcttt<br>10441 agttcacggg gaccattgcc tgcttatcta gggtctaaaa catctgaatc tacatctatt<br>10501 ttgcagcctt gggaaaggga aagcaaagtc ccactgatta aaagagctac acgtcttaga<br>10561 gatgctatct cttggtttgt tgaacccgac tctaaactag caatgactat actttctaac<br>10621 atccactctt taacaggcga agaatggacc aaaaggcagc atgggttcaa aagaacaggg<br>10681 tctgcccttc ataggttttc gacatctcgg atgagccatg gtgggttcgc atctcagagc<br>10741 actgcagcat tgaccaggtt gatggcaact acagacacca tgagggatct gggagatcag<br>10801 aatttcgact ttttattcca agcaacgttg ctctatgctc aaattaccac cactgttgca<br>10861 agagacggat ggatcaccag ttgtacagat cattatcata ttgcctgtaa gtcctgtttg<br>10921 agacccatag aagagatcac cctggactca agtatggact acacgccccc agatgtatcc<br>10981 catgtgctga agacatggag gaatgggaa ggttcgtggg gacaagagat aaaacagatc<br>11041 tatcctttag aagggaattg gaagaattta gcacctgctg agcaatccta tcaagtcggc<br>11101 agatgtatag gttttctata tggagacttg gcgtatagaa aatctactca tgccgaggac<br>11161 agttctctat ttcctctatc tatacaaggt cgtattagag gtcgaggttt cttaaaaggg<br>11221 ttgctagacg gattaatgag agcaagttgc tgccaagtaa tacaccggag aagtctggct<br>11281 catttgaaga ggccggccaa cgcagtgtac ggaggtttga tttacttgat tgataaattg<br>11341 agtgtatcac ctccattcct ttctcttact agatcaggac ctattagaga cgaattagaa<br>11401 acgattcccc acaagatccc aacctcctat ccgacaagca accgtgatat gggggtgatt<br>11461 gtcagaaatt acttcaaata ccaatgccgt ctaattgaaa agggaaaata cagatcacat<br>11521 tattcacaat tatggttatt ctcagatgtc ttatccatag acttcattgg accattctct<br>11581 atttccacca ccctcttgca aatcctatac aagccatttt tatctgggaa agataagaat<br>11641 gagttgagag agctggcaaa tctttcttca ttgctaagat caggagaggg gtgggaagac<br>11701 atacatgtga aattcttcac caaggacata ttattgtgtc cagaggaaat cagacatgct<br>11761 tgcaagttcg ggattgctaa ggataataat aaagacatga gctatccccc ttggggaagg<br>11821 gaatccagag ggacaattac aacaatccct gtttattata cgaccaccc ttacccaaag<br>11881 atgctagaga tgcctccaag aatccaaaat cccctgctgt ccggaatcag gttgggccaa<br>11941 ttaccaactg gcgctcatta taaaattcgg agtatattac atggaatggg aatccattac<br>12001 agggacttct tgagttgtgg agacgctcc ggagggatga ctgctgcatt actacgagaa<br>12061 aatgtgcata gcagaggaat tcaatagt ctgttagaat tatcagggtc agtcatgcga<br>12121 ggcgcctctc ctgagccccc cagtgcccta gaaacttag gaggagataa atcgagatgt<br>12181 gtaaatggtg aaacatgttg gaatatcca tctgacttat gtgacccaag gacttgggac<br>12241 tatttcctcc gactcaaagc aggcttgggg cttcaaattg atttaattgt aatggatatg<br>12301 gaagttcggg attcttctac tagcctgaaa attgagacga atgttagaaa ttatgtgcac<br>12361 cggattttgg atgagcaagg agttttaatc tacaagactt atggaacata tatttgtgag<br>12421 agcgaaaaga atgcagtaac aatccttggt cccatgttca agacggtcga cttagttcaa<br>12481 acagaattta gtagttctca aacgtctgaa gtatatatgg tatgtaaagg tttgaagaaa<br>12541 ttaatcgatg aacccaatcc cgattggtct tccatcaatg aatcctggaa aaacctgtac<br>12601 gcattccagt catcagaaca ggaatttgcc agagcaaaga aggttagtac atactttacc<br>12661 ttgacaggta ttcccctccca attcattcct gatccttttg taaacattga gactatgcta<br>12721 caaatattcg gagtacccac gggtgtgtct catgcggctg ccttaaaatc atctgataga<br>12781 cctgcagatt tattgaccat tagcctttt tatatggcga ttatatcgta ttataacatc<br>12841 aatcatatca gagtaggacc gataccctcg aaccccccat cagatgaat tgcacaaaat<br>12901 gtggggatcg ctataactgg tataagcttt tggctgagtt tgatggagaa agacattcca<br>12961 ctatatcaac agtgtttagc agttatccag caatcattcc cgattaggtg ggaggctgtt<br>13021 tcagtaaaag gaggatacaa gcagaagtgg agtactagag gtgatgggct cccaaaagat<br>13081 acccgaattt cagactcctt ggccccaatc gggaactgga tcagatctct ggaattggtc<br>13141 cgaaaccaag ttcgtctaaa tccattcaat gagatcttgt tcaatcagct atgtcgtaca<br>13201 gtggataatc atttgaaatg gtcaaatttg cgaagaaaca caggaatgat tgaatggatc<br>13261 aatagacgaa tttcaaaaga gaccggtctc atactgatgt tgaagagtga cctacacgag<br>13321 gaaaactctt ggagagatta aaaaatcatg aggagactcc aaactttaag tatgaaaaaa<br>13381 actttgatcc ttaagaccct cttgtggttt ttattttta tctggttttg tggtcttcgt | |
| Amino acid sequence for VSV-M protein in rVSVΔG-SARS-CoV-2 clone MB1 | Please see FIG. 24D. | 151 |
| Amino acid sequence for VSV-L protein in rVSVΔG-SARS-CoV-2 clone MB1, MB2, and Vectors A and B | Please see FIGS. 21F, 22E, 23E, and 24F. | 152 |
| Amino acid sequence for SARS-CoV-2 S protein in | Please see FIG. 24E. | 153 |

TABLE 1-continued

Description of the Sequences

| Description | Sequences | SEQ ID NO |
|---|---|---|
| rVSVΔG-SARS-CoV-2 clone MB1 | | |
| Nucleotide sequence for rVSVΔG-SARS-CoV-2 clone MB2 | 1 ACGAAGACAA ACAAACCATT ATTATCATTA AAAGGCTCAG GAGAAACTTT<br>51 AACAGTAATC AAAATGTCTG TTACAGTCAA GAGAATCATT GACAACACAG<br>101 TCGTAGTTCC AAAACTTCCT GCAAATGAGG ATCCAGTGGA ATACCCGGCA<br>151 GATTACTTCA GAAAATCAAA GGAGATTCCT CTTTACATCA ATACTACAAA<br>201 AAGTTTGTCA GATCTAAGAG GATATGTCTA CCAAGGCCTC AAATCCGGAA<br>251 ATGTATCAAT CATACATGTC AACAGCTACT TGTATGGAGC ATTAAAGGAC<br>301 ATCCGGGGTA AGTTGGATAA AGATTGGTCA AGTTTCGGAA TAAACATCGG<br>351 GAAAGCAGGG GATACAATCG GAATATTTGA CCTTGTATCC TTGAAAGCCC<br>401 TGGACGGCGT ACTTCCAGAT GGAGTATCGG ATGCTTCCAG AACCAGCGCA<br>451 GATGACAAAT GGTTGCCTTT GTATCTACTT GGCTTATACA GAGTGGGCAG<br>501 AACACAAATG CCTGAATACA GAAAAAGCT CATGGATGGG CTGACAAATC<br>551 AATGCAAAAT GATCAATGAA CAGTTTGAAC CTCTTGTGCC AGAAGGTCGT<br>601 GACATTTTTG ATGTGTGGGG AAATGACAGT AATTACACAA AAATTGTCGC<br>651 TGCAGTGGAC ATGTTCTTCC ACATGTTCAA AAACATGAA TGTGCCTCGT<br>701 TCAGATACGG AACTATTGTT CCAGATTCA AAGATTGTGC TGCATTGGCA<br>751 ACATTTGGAC ACCTCTGCAA AATAACCGGA ATGTCTACAG AAGATGTAAC<br>801 GACCTGGATC TTGAACCGAG AAGTTGCAGA TGAAATGGTC CAAATGATGC<br>851 TTCCAGGCCA AGAAATTGAC AAGGCCGATT CATACATGCC TTATTTGATC<br>901 GACTTTGGAT TGTCTTCTAA GTCTCCATAT TCTTCCGTCA AAAACCCTGC<br>951 CTTCCACTTC TGGGGGCAAT TGACAGCTCT TCTGCTCAGA TCCACCAGAG<br>1001 CAAGGAATGC CCGACAGCCT GATGACATTG AGTATACATC TCTTACTACA<br>1051 GCAGGTTTGT TGTACGCTTA TGCAGTAGGA TCCTCTGCCG ACTTGGCACA<br>1101 ACAGTTTTGT GTTGGAGATA ACAAATACAC TCCAGATGAT AGTACCGGAG<br>1151 GATTGACGAC TAATGCACCG CCACAAGGCA GAGATGTGGT CGAATGGCTC<br>1201 GGATGGTTTG AAGATCAAAA CAGAAAACCG ACTCCTGATA TGATGCAGTA<br>1251 TGCGAAAAGA GCAGTCATGT CACTGCAAGG CCTAAGAGAA AAGACAATTG<br>1301 GCAAGTATGC TAAGTCAGAA TTTGACAAAT GACCCTATAA TTCTCAGATC<br>1351 ACCTATTATA TATTATGCTA CATATGAAAA AAACTAACAG ATATCATGGA<br>1401 TAATCTCACA AAAGTTCGTG AGTATCTCAA GTCCTATTCT CGTCTGGATC<br>1451 AGGCGGTAGG AGAGATAGAT GAGATCGAAG CACAACGAGC TGAAAGTCC<br>1501 AATTATGAGT TGTTCCAAGA GGATGGAGTG GAAGAGCATA CTAAGCCCTC<br>1551 TTATTTTCAG GCAGCAGATG ATTCTGACAC AGAATCTGAA CCAGAAATTG<br>1601 AAGACAATCA AGGCTTGTAT GCACCAGATC CAGAAGCTGA GCAAGTTGAA<br>1651 GGCTTTATAC AGGGGCCTTT AGATGACTAT GCAGATGAGG AAGTGGATGT<br>1701 TGTATTTACT TCGGACTGGA AACAGCCTGA GCTTGAATCT GACGAGCATG<br>1751 GAAAGACCTT ACGGTTGACA TCGCCAGAGG GTTTAAGTGG AGAGCAGAAA<br>1801 TCCCAGTGGC TTTCGACGAT TAAAGCAGTC GTGCAAAGTG CCAAATACTG<br>1851 GAATCTGGCA GAGTGCACAT TTGAAGCATC GGGAGAAGGG GTCATTATGA<br>1901 AGGAGCGCCA GATAACTCCG GATGTATATA AGGTCACTCC AGTGATGAAC<br>1951 ACACATCCGT CCCAATCAGA AGCAGTATCA GATGTTTGGT CTCTCTCAAA<br>2001 GACATCCATG ACTTTCCAAC CCAAGAAAGC AAGTCTTCAG CCTCTCACCA<br>2051 TATCCTTGGA TGAATTGTTC TCATCTAGAG GAGAGTTCAT CTCTGTCGGA<br>2101 GGTGACGGAC GAATGTCTCA TAAAGAGGCC ATCCTGCTCG GCCTGAGATA<br>2151 CAAAAAGTTG TACAATCAGG CGAGAGTCAA ATATTCTCTG TAGACTATGA<br>2201 AAAAAGTAA CAGATATCAC GATCTAAGTG TTATCCCAAT CCATTCATCA<br>2251 TGAGTTCCTT AAAGAAGATT CTCGGTCTGA AGGGGAAAGG TAAGAAATCT<br>2301 AAGAAATTAG GGATCGCACC ACCCCCTTAT GAAGAGGACA CTAGCATGGA<br>2351 GTATGCTCCG AGCGCTCCAA TTGACAAATC CTATTTTGGA GTTGACGAGA<br>2401 TGGACACCTA TGATCCGAAT CAATTAAGAT ATGAGAAATT CTTCTTTACA<br>2451 GTGAAAATGA CGGTTAGATC TAATCGTCCG TTCAGAACAT ACTCAGATGT<br>2501 GGCAGCCGCT GTATCCCATT GGGATCACAT GTACATCGGA ATGGCAGGGA<br>2551 AACGTCCCTT CTACAAAATC TTGGCTTTTT TGGGTTCTTC TAATCTAAAG<br>2601 GCCACTCCAG CGGTATTGGC AGATCAAGGT CAACCAGAGT ATCACGCTCA<br>2651 CTGCGAAGGC AGGGCTTATT TGCCACATAG GATGGGGAAG ACCCCTCCCA<br>2701 TGCTCAATGT ACCAGAGCAC TTCAGAAGAC CATTCAATAT AGGTCTTTAC<br>2751 AAGGGAACGA TTGAGCTCAC AATGACCATC TACGATGATG AGTCACTGGA<br>2801 AGCAGCTCCT ATGATCTGGG ATCATTTCAA TTCTTCCAAA TTTTCTGATT<br>2851 TCAGAGAGAA GGCCTTAATG TTTGGCCTGA TTGTCGAGAA AAAGGCATCT<br>2901 GGAGCGTGGG TCCTGGACTC TATCGGCCAC TTCAAATGAG CTAGTCTAAC<br>2951 TTCTAGCTTC TGAACAATCC CCGGTTTACT CAGTCTCCCC TAATTCCAGC<br>3001 CTCTCGAACA ACTAATATCC TGTCTTTTCT ATCCCTATGA AAAAACTAA<br>3051 CAGAGATCGA TCTGTTTACG CGCTAGTGGA TCCTACTCGA GAGGAGCCAC<br>3101 CATGTTCGTG TTCCTGGTGC TATTACCTCT GGTTTCGTCT CAATGCGTAA<br>3151 ACCTTACAAC TAGAACTCAG CTTCCTCCAG CATACACAAA TTCCTTCACT<br>3201 CGCGGAGTGT ATTATCCTGA TAAGGTCTTT CGATCATCAG TGTTGCATTC<br>3251 CACCCAGGAT TTGTTTCTCC CGTTCTTTTC AAATGTAACT TGGTTCCATG<br>3301 CTATACATGT TTCCGGAACC AATGGAACAA AGAGATTTGA TAACCCAGTG<br>3351 TTACCATTTA ACGACGGAGT TTATTTCGCA TCAACTGAGA AATCCAATAT<br>3401 CATTAGAGGC TGGATTTTCG GAACGACCCT GGATTCTAAA ACGCAATCCT<br>3451 TGCTGATTGT TAATAATGCA ACAAATGTGG TCATTAAAGT CTGTGAATTC<br>3501 CAATTTTGCA ATGATCCATT TCTCGGCGTC TATTACCACA AGAATAACAA | 154 |

TABLE 1-continued

Description of the Sequences

| Description | Sequences | SEQ ID NO |
|---|---|---|
| | 3551 ATCTTGGATG GAGTCAGAGT TCAGGGTTTA TAGTTCCGCA AATAATTGTA | |
| | 3601 CTTTTGAATA CGTTTCCCAA CCATTCTTAA TGGACTTGGA GGGAAAACAG | |
| | 3651 GGAAATTTTA AGAATCTAAG AGAATTCGTC TTTAAGAATA TTGATGGATA | |
| | 3701 TTTCAAGATC TATTCAAAAC ATACACCTAT AAACCTAGTT AGAGATCTCC | |
| | 3751 CGCAAGGGTT TTCAGCCCTA GAGCCACTAG TTGACCTGCC AATTGGGATC | |
| | 3801 AACATTACTA GATTCCAGAC CCTACTCGCT CTGCATCGGT CATATTTGAC | |
| | 3851 ACCAGGAGAT TCATCGTCAG GATGGACCGC TGGAGCAGCT GCTTACTATG | |
| | 3901 TTGGGTATCT GCAACCTAGA ACATTTCTCC TAAAGTATAA TGAAAACGGG | |
| | 3951 ACTATTACAG ACGCAGTCGA TTGCGCACTG GATCCACTCT CAGAGACAAA | |
| | 4001 GTGCACTCTA AAATCATTCA CTGTCGAGAA AGGAATCTAT CAAACATCAA | |
| | 4051 ATTTCAGGGT CCAGCCAACT GAGAGTATTG TCCGGTTCCC TAACATAACT | |
| | 4101 AACTTGTGCC CCTTCGGAGA GGTTTTCAAT GCTACTCGGT TCGCCAGCGT | |
| | 4151 CTACGCATGG AACAGAAAGA GGATTTCAAA CTGTGTCGCA GATTATAGCG | |
| | 4201 TCCTCTATAA TTCAGCATCA TTCAGTACAT TTAAATGCTA TGGTGTCAGC | |
| | 4251 CCCACCAAAC TTAATGACTT ATGTTTTACC AATGTATATG CAGATTCCTT | |
| | 4301 TGTAATCAGA GGTGACGAAG TGAGGCAAAT CGCACCTGGA CAGACCGGAA | |
| | 4351 AGATTGCTGA TTATAATTAT AAACTCCCTG ATGATTTTAC CGGATGTGTT | |
| | 4401 ATTGCTTGGA ACAGCAATAA CCTCGATAGT AAGGTCGGAG GAAACTATAA | |
| | 4451 CTATTTGTAC AGACTGTTTA GAAAGTCGAA TTTGAAACCT TTTGAAAGAG | |
| | 4501 ACATATCCAC CGAGATTTAC CAGGCGGGCA GCACACCGTG TAATGGTGTA | |
| | 4551 GAAGGATTCA ATTGTTACTT TCCCCTGCAA TCATATGGGT TTCAACCAAC | |
| | 4601 CAATGGAGTC GGATATCAAC CATATCGTGT CGTCGTCCTT TCCTTCGAGC | |
| | 4651 TGCTTCATGC ACCAGCTACA GTCTGCGGAC CTAAGAAGAG CACTAATCTT | |
| | 4701 GTCAAGAACA AATGTGTGAA CTTTAATTTT AATGGATTAA CAGGAACCGG | |
| | 4751 AGTTTTGACC GAGAGTAATA AGAAGTTCTT GCCGTTCCAG CAATTTGGAC | |
| | 4801 GAGACATTGC TGACACCACA GATGCGGTTC GTGACCCGCA AACTTTAGAG | |
| | 4851 ATCCTAGACA TCACCCCATG TTCATTCGGT GGAGTTTCCG TTATTACTCC | |
| | 4901 TGGAACGAAT ACAAGCAATC AAGTTGCCGT TCTCTATCAA GATGTTAATT | |
| | 4951 GTACAGAAGT GCCTGTGGCC ATTCATGCAG ATCAACTAAC ACCAACTTGG | |
| | 5001 AGAGTTTACA GCACTGGGTC CAATGTCTTC CAAACGCGCG CCGGCTGCCT | |
| | 5051 CATTGGTGCA GAATATGTGA ATAACTCATA CGAATGTGAC ATTCCAATCG | |
| | 5101 GTGCCGGCAT ATGCGCCTCT TACCAGACTC AGACTAATTC GCCAAGAAGA | |
| | 5151 GCCAGGTCTG TCGCAAGTCA GTCAATTATT GCATACACAA TGTCGTTAGG | |
| | 5201 AGCAGAGAAT AGTGTAGCAT ACTCAAACAA TTCTATAGCA ATACCTACCA | |
| | 5251 ACTTCACTAT ATCAGTAACT ACAGAAATAT TGCCAGTATC CATGACTAAA | |
| | 5301 ACAAGTGTGG ATTGCACCAT GTACATCTGT GGAGATTCCA CAGAATGCAG | |
| | 5351 CAATCTTCTC TTGCAATACG GATCATTCTG CACACAACTG AATAGGGCAC | |
| | 5401 TGACTGGAAT TGCAGTCGAG CAGGATAAGA ACACACAGGA GGTGTTTGCC | |
| | 5451 CAAGTCAAAC AAATATACAA AACACCACCC ATCAAGGATT TTGGAGGATT | |
| | 5501 TAATTTCTCA CAAATACTCC CCGACCCATC CAAGCCCTCC AAAAGGAGTT | |
| | 5551 TCATTGAGGA CCTCTTGTTT AATAAGGTTA CCTTGGCAGA TGCCGGGTTT | |
| | 5601 ATTAAGCAGT ACGGCGACTG TCTTGGAGAC ATAGCAGCCA GAGATCTAAT | |
| | 5651 TTGTGCCCAG AAATTCAATG GACTGACAGT CCTGCCTCCC TTATTAACTG | |
| | 5701 ATGAGATGAT AGCTCAGTAT ACATCAGCAT TGTTGGCTGG TACAATTACA | |
| | 5751 TCTGGATGGA CATTTGGTGC CGGAGCGGCA TTACAAATCC CTTTTGCAAT | |
| | 5801 GCAAATGGCC TATAGATTTA ATGGAATCGG AGTAACTCAA AATGTTTTAT | |
| | 5851 ATGAGAATCA GAAATTAATT GCAAATCAAT TCAATTCAGC TATAGGAAAG | |
| | 5901 ATTCAGGATT CACTCAGTAG TACAGCAAGC GCTCTAGGCA AATTACAAGA | |
| | 5951 CGTCGTCAAT CAGAATGCAC AGGCATTAAA TACACTGGTG AAGCAATTGA | |
| | 6001 GTTCCAATTT CGGAGCAATT TCATCTGTTC TAAATGATAT ATTGTCAAGA | |
| | 6051 CTGGATAAAG TAGAAGCCGA GGTCCAAATC GATAGGCTGA TCACAGGAAG | |
| | 6101 ACTTCAATCA CTACAGACAT ACGTCACCCA ACAACTCATC AGAGCAGCAG | |
| | 6151 AAATTAGAGC CTCTGCTAAT CTAGCCGCAA CAAAGATGTC AGAGTGCGTA | |
| | 6201 TTGGGACAAT CTAAGAGGGT CGACTTTTGT GGAAAGGGGT ATCACTTGAT | |
| | 6251 GTCCTTTCCT CAATCTGCAC CACACGGAGT TGTCTTCTTA CATGTAACAT | |
| | 6301 ATGTGCCCGC TCAAGAAAAG AATTTCACTA CAGCACCTGC AATATGTCAT | |
| | 6351 GACGGAAAAG CACATTTTCC TCGGGAGGGA GTTTTCGTTT CTAATGGAAC | |
| | 6401 CCATTGGTTC GTGACCCAAA GGAACTTTTA CGAGCCTCAA ATAATTACAA | |
| | 6451 CTGATAATAC ATTCGTTTCT GGAAATTGCG ACGTAGTTAT AGGTATTGTA | |
| | 6501 AATAATACTG TTTATGACCC TTTACAACCT GAACTCGATT CCTTCAAGGA | |
| | 6551 AGAACTCGAC AAATATTTTA AGAATCACAC CTCACCGGAC GTTGACTTAG | |
| | 6601 GAGACATTTC CGGGATTAAC GCTAGTGTAG TCAATATCCA AAAGGAGATA | |
| | 6651 GATAGACTGA ATGAGGTAGC AAAGAATCTT AATGAATCTT TGATCGACCT | |
| | 6701 TCAGGAGCTG GGGAAGTACG AACAATACAT AAAATGGCCA TGGTACATTT | |
| | 6751 GGCTCGGGTT TATTGCTGGA CTAATTGCAA TAGTCATGGT CACTATCATG | |
| | 6801 CTGTGTTGTA TGACATCGTG CTGCTCATGC CTCAAGGGAT GTTGTAGCTG | |
| | 6851 TTGATCTTGT TGCAAGTTCG ATGAGGATGA TTCAGAACCA GTTTTAAAAG | |
| | 6901 GAGTAAAGTT GCATTACACA TAAAGGCTAG CTGTTTACGC GTTATCCATG | |
| | 6951 CTCAAAGAGG CCTCAATTAT ATTTGAGTTT TTAATTTTTA TGAAAAAAAC | |
| | 7001 TAACAGCAAT CATGGAAGTC CACGATTTTG AGACCGACGA GTTCAATGAT | |
| | 7051 TTCAATGAAG ATGACTATGC CACAAGAGAA TTCCTGAATC CCGATGAGCG | |
| | 7101 CATGACGTAC TTGAATCATG CTGATTACAA CCTGAATTCT CCTCTAATTA | |
| | 7151 GTGATGATAT TGACAATTTA ATCAGGAAAT TCAATTCTCT TCCAATTCCC | |
| | 7201 TCGATGTGGG ATAGTAAGAA CTGGGATGGA GTTCTTGAGA TGTTAACGTC | |

TABLE 1-continued

Description of the Sequences

| Description | Sequences | SEQ ID NO |
|---|---|---|
| | 7251 ATGTCAAGCC AATCCCATCC CAACATCTCA GATGCATAAA TGGATGGGAA | |
| | 7301 GTTGGTTAAT GTCTGATAAT CATGATGCCA GTCAAGGGTA TAGTTTTTTA | |
| | 7351 CATGAAGTGG ACAAAGAGGC AGAAATAACA TTTGACGTGG TGGAGACCTT | |
| | 7401 CATCCGCGGC TGGGGCAACA AACCAATTGA ATACATCAAA AAGGAAAGAT | |
| | 7451 GGACTGACTC ATTCAAAATT CTCGCTTATT TGTGTCAAAA GTTTTTGGAC | |
| | 7501 TTACACAAGT TGACATTAAT CTTAAATGCT GTCTCTGAGG TGGAATTGCT | |
| | 7551 CAACTTGGCG AGGACTTTCA AAGGCAAAGT CAGAAGAAGT TCTCATGGAA | |
| | 7601 CGAACATATG CAGGATTAGG GTTCCCAGCT TGGGTCCTAC TTTTATTTCA | |
| | 7651 GAAGGATGGG CTTACTTCAA GAAACTTGAT ATTCTAATGG ACCGAAACTT | |
| | 7701 TCTGTTAATG GTCAAAGATG TGATTATAGG GAGGATGCAA ACGGTGCTAT | |
| | 7751 CCATGGTATG TAGAATAGAC AACCTGTTCT CAGAGCAAGA CATCTTCTCC | |
| | 7801 CTTCTAAATA TCTACAGAAT TGGAGATAAA ATTGTGGAGA GGCAGGGAAA | |
| | 7851 TTTTTCTTAT GACTTGATTA AATGGTGGA ACCGATATGC AACTTGAAGC | |
| | 7901 TGATGAAATT AGCAAGAGAA TCAAGGCCTT TAGTCCCACA ATTCCCTCAT | |
| | 7951 TTTGAAAATC ATATCAAGAC TTCTGTTGAT GAAGGGGCAA AAATTGACCG | |
| | 8001 AGGTATAAGA TTCCTCCATG ATCAGATAAT GAGTGTGAAA ACAGTGGATC | |
| | 8051 TCACACTGGT GATTTATGGA TCGTTCAGAC ATTGGGGTCA TCCTTTTATA | |
| | 8101 GATTATTACA CTGGACTAGA AAAATTACAT TCCCAAGTAA CCATGAAGAA | |
| | 8151 AGATATTGAT GTGTCATATG CAAAAGCACT TGCAAGTGAT TTAGCTCGGA | |
| | 8201 TTGTTCTATT TCAACAGTTC AATGATCATA AAAAGTGGTT CGTGAATGGA | |
| | 8251 GACTTGCTCC CTCATGATCA TCCCTTTAAA AGTCATGTTA AAGAAAATAC | |
| | 8301 ATGGCCCACA GCTGCTAAG TTCAAGATTT TGGAGATAAA TGGCATGAAC | |
| | 8351 TTCCGCTGAT TAAATGTTTT GAAATACCCG ACTTACTAGA CCCATCGATA | |
| | 8401 ATATACTCTG ACAAAAGTCA TTCAATGAAT AGGTCAGAGG TGTTGAAACA | |
| | 8451 TGTCCGAATG AATCCGAACA CTCCTATCCC TAGTAAAAAG GTGTTGCAGA | |
| | 8501 CTATGTTGGA CACAAAGGCT ACCAATTGGA AAGAATTTCT TAAAGAGATT | |
| | 8551 GATGAGAAGG GCTTAGATGA TGATGATCTA ATTATTGGTC TTAAAGGAAA | |
| | 8601 GGAGAGGGAA CTGAAGTTGG CAGGTAGATT TTTCTCCCTA ATGTCTTGGA | |
| | 8651 AATTGCGAGA ATACTTTGTA ATTACCGAAT ATTTGATAAA GACTCATTTC | |
| | 8701 GTCCCTATGT TTAAAGGCCT GACAATGGCG GACGATCTAA CTGCAGTCAT | |
| | 8751 TAAAAAGATG TTAGATTCCT CATCCGGCCA AGGATTGAAG TCATATGAGG | |
| | 8801 CAATTTGCAT AGCCAATCAC ATTGATTACG AAAAATGGAA TAACCACCAA | |
| | 8851 AGGAAGTTAT CAAACGGCCC AGTGTTCCGA GTTATGGGCC AGTTCTTAGG | |
| | 8901 TTATCCATCC TTAATCGAGA GAACTCATGA ATTTTTTGAG AAAAGTCTTA | |
| | 8951 TATACTACAA TGGAAGACCA GACTTGATGC GTGTTCACAA CAACACACTG | |
| | 9001 ATCAATTCAA CCTCCCAACG AGTTTGTTGG CAAGGACAAG AGGGTGGACT | |
| | 9051 GGAAGGTCTA CGGCAAAAAG GATGGAGTAT CCTCAATCTA CTGGTTATTC | |
| | 9101 AAAGAGAGGC TAAAATCAGA AACACTGCTG TCAAAGTCTT GGCACAAGGT | |
| | 9151 GATAATCAAG TTATTTGCAC ACAGTATAAA ACGAAGAAAT CGAGAAACGT | |
| | 9201 TGTAGAATTA CAGGGTGCTC TCAATCAAAT GGTTTCTAAT AATGAGAAAA | |
| | 9251 TTATGACTGC AATCAAAATA GGGACAGGGA AGTTAGGACT TTTGATAAAT | |
| | 9301 GACGATGAGA CTATGCAATC TGCAGATTAC TTGAATTATG GAAAATACC | |
| | 9351 GATTTTCCGT GGAGTGATTA GAGGGTTAGA GACCAAGAGA TGGTCACGAG | |
| | 9401 TGACTTGTGT CACCAATGAC CAAATACCCA CTTGTGCTAA TATAATGAGC | |
| | 9451 TCAGTTTCCA CAAATGCTCT CACCGTAGCT CATTTTGCTG AGAACCCAAT | |
| | 9501 CAATGCCATG ATACAGTACA ATTATTTTGG GACATTTGCT AGACTCTTGT | |
| | 9551 TGATGATGCA TGATCCTGCT CTTCGTCAAT CATTGTATGA AGTTCAAGAT | |
| | 9601 AAGATACCAG GCTTGCACAG TTCTACTTTC AAATACGCCA TGTTGTATTT | |
| | 9651 GGACCCTTCC ATTGGAGGAG TGTCGGGCAT GTCTTTGTCC AGGTTTTTGA | |
| | 9701 TTAGAGCCTT CCCAGATCCC GTAACAGAAA GTCTCTCATT CTGGAGATTC | |
| | 9751 ATCCATGTAC ATGCTCGAAG TGAGCATCTG AAGGAGATGA GTGCAGTATT | |
| | 9801 TGGAAACCCC GAGATAGCCA AGTTTCGAAT AACTCACATA GACAAGCTAG | |
| | 9851 TAGAAGATCC AACCTCTCTG AACATCGCTA TGGGAATGAG TCCAGCGAAC | |
| | 9901 TTGTTAAAGA CTGAGGTTAA AAAATGCTTA ATCGAATCAA GACAAACCAT | |
| | 9951 CAGGAACCAG GTGATTAAGG ATGCAACCAT ATATTTGTAT CATGAAGAGG | |
| | 10001 ATCGGCTCAG AAGTTTCTTA TGGTCAATAA ATCCTCTGTT CCCTAGATTT | |
| | 10051 TTAAGTGAAT TCAAATCAGG CACTTTTTTG GGAGTCGCAG ACGGGCTCAT | |
| | 10101 CAGTCTATTT CAAAATTCTC GTACTATTCG GAACTCCTTT AAGAAAAAGT | |
| | 10151 ATCATAGGGA ATTGGATGAT TTGATTGTGA GGAGTGAGGT ATCCTCTTTG | |
| | 10201 ACACATTTAG GGAAACTTCA TTTGAGAAGG GGATCATGTA AAATGTGGAC | |
| | 10251 ATGTTCAGCT ACTCATGCTG ACACATTAAG ATACAAATCC TGGGGCCGTA | |
| | 10301 CAGTTATTGG GACAACTGTA CCCCATCCAT TAGAAATGTT GGGTCCACAA | |
| | 10351 CATCGAAAAG AGACTCCTTG TGCACCATGT AACACATCAG GGTTCAATTA | |
| | 10401 TGTTTCTGTG CATTGTCCAG ACGGGATCCA TGACGTCTTT AGTTCACGGG | |
| | 10451 GACCATTGCC TGCTTATCTA GGGTCTAAAA CATCTGAATC TACATCTATT | |
| | 10501 TTGCAGCCTT GGGAAAGGGA AAGCAAAGTC CCACTGATTA AAAGAGCTAC | |
| | 10551 ACGTCTTAGA GATGCTATCT CTTGGTTTGT TGAACCCGAC TCTAAACTAG | |
| | 10601 CAATGACTAT ACTTTCTAAC ATCCACTCTT TAACAGGCGA AGAATGGACC | |
| | 10651 AAAAGGCAGC ATGGGTTCAA AAGGACGGG TCTGCCCTTC ATAGGTTTTG | |
| | 10701 GACATCTCGG ATGAGCCATG GTGGGTTCGC ATCTCAGAGC ACTGCAGCAT | |
| | 10751 TGACCAGGTT GATGGCAACT ACAGACACCA TGAGGGATCT GGGAGATCAG | |
| | 10801 AATTTCGACT TTTTATTCCA AGCAACGTTG CTCTATGCTC AAATTACCAC | |
| | 10851 CACTGTTGCA AGAGACGGAT GGATCACCAG TTGTACAGAT CATTATCATA | |
| | 10901 TTGCCTGTAA GTCCTGTTTG AGACCCATAG AAGAGATCAC CCTGGACTCA | |

TABLE 1-continued

Description of the Sequences

| Description | Sequences | SEQ ID NO |
|---|---|---|
| | 10951 AGTATGGACT ACACGCCCCC AGATGTATCC CATGTGCTGA AGACATGGAG<br>11001 GAATGGGGAA GGTTCGTGGG GACAAGAGAT AAAACAGATA TATCCTTTAG<br>11051 AAGGGAATTG GAAGAATTTA GCACCTGCTG AGCAATCCTA TCAAGTCGGC<br>11101 AGATGTATAG GTTTTCTATA TGGAGACTTG GCGTATAGAA AATCTACTCA<br>11151 TGCCGAGGAC AGTTCTCTAT TTCCTCTATC TATACAAGGT CGTATTAGAG<br>11201 GTCGAGGTTT CTTAAAAGGG TTGCTAGACG GATTAATGAG AGCAAGTTGC<br>11251 TGCCAAGTAA TACACCGGAG AAGTCTGGCT CATTTGAAGA GGCCGGCCAA<br>11301 CGCAGTGTAC GGAGGTTTGA TTTACTTGAT TGATAAATTG AGTGTATCAC<br>11351 CTCCATTCCT TTCTCTTACT AGATCAGGAC CTATTAGAGA CGAATTAGAA<br>11401 ACGATTCCCC ACAAGATCCC AACCTCCTAT CCGACAAGCA ACCGTGATAT<br>11451 GGGGGTGATT GTCAGAAATT ACTTCAAATA CCAATGCCGT CTAATTGAAA<br>11501 AGGGAAAATA CAGATCACAT TATTCACAAT TATGGTTATT CTCAGATGTC<br>11551 TTATCCATAG ACTTCATTGG ACCATTCTCT ATTTCCACCA CCCTCTTGCA<br>11601 AATCCTATAC AAGCCATTTT TATCTGGGAA AGATAAGAAT GAGTTGAGAG<br>11651 AGCTGGCAAA TCTTTCTTCA TTGCTAAGAT CAGGAGAGGG GTGGGAAGAC<br>11701 ATACATGTGA AATTCTTCAC CAAGGACATA TTATTGTGTC CAGAGGAAAT<br>11751 CAGACATGCT TGCAAGTTCG GGATTGCTAA GGATAATAAT AAAGACATGA<br>11801 GCTATCCCCC TTGGGGAAGG GAATCCAGAG GGACAATTAC AACAATCCCT<br>11851 GTTTATTATA CGACCACCCC TTACCCAAAG ATGCTAGAGA TGCCTCCAAG<br>11901 AATCCAAAAT CCCCTGCTGT CCGGAATCAG GTTGGGCCAA TTACCAACTG<br>11951 GCGCTCATTA TAAAATTCGG AGTATATTAC ATGGAATGGG AATCCATTAC<br>12001 AGGGACTTCT TGAGTTGTGA AGACGGCTCC GGAGGGATGA CTGCTGCATT<br>12051 ACTACGAGAA AATGTGCATA GCAGAGGAAT ATTCAATAGT CTGTTAGAAT<br>12101 TATCAGGGTC AGTCATGCGA GGCGCCTCTC CTGAGCCCCC CAGTGCCCTA<br>12151 GAAACTTTAG GAGGAGATAA ATCGAGATGT GTAAATGGTG AAACATGTTG<br>12201 GGAATATCCA TCTGACTTAT GTGACCCAAG GACTTGGGAC TATTTCCTCC<br>12251 GACTCAAAGC AGGCTTGGGG CTTCAAATTG ATTTAATTGT AATGGATATG<br>12301 GAAGTTCGGG ATTCTTCTAC TAGCCTGAAA ATTGAGACGA ATGTTAGAAA<br>12351 TTATGTGCAC CGGATTTTGG ATGAGCAAGG AGTTTTAATC TACAAGACTT<br>12401 ATGGAACATA TATTTGTGAG AGCGAAAAGA ATGCAGTAAC AATCCTTGGT<br>12451 CCCATGTTCA AGACGGTCGA CTTAGTTCAA ACAGAATTTA GTAGTTCTCA<br>12501 AACGTCTGAA GTATATATGG TATGTAAAGG TTTGAAGAAA TTAATCGATG<br>12551 AACCCAATCC CGATTGGTCT TCCATCAATG AATCCTGGAA AAACCTGTAC<br>12601 GCATTCCAGT CATCAGAACA GGAATTTGCC AGAGCAAAGA AGGTTAGTAC<br>12651 ATACTTTACC TTGACAGGTA TTCCCTCCCA ATTCATTCCT GATCCTTTTG<br>12701 TAAACATTGA GACTATGCTA CAAATATTCG GAGTACCCAC GGGTGTGTCT<br>12751 CATGCGGCTG CCTTAAAATC ATCTGATAGA CCTGCAGATT TATTGACCAT<br>12801 TAGCCTTTTT TATATGGCGA TTATATCGTA TTATAACATC AATCATATCA<br>12851 GAGTAGGACC GATACCTCCG AACCCCCCAT CAGATGGAAT TGCACAAAAT<br>12901 GTGGGGATCG CTATAACTGG TATAAGCTTT TGGCTGAGTT TGATGGAGAA<br>12951 AGACATTCCA CTATATCAAC AGTGTTTAGC AGTTATCCAG CAATCATTCC<br>13001 CGATTAGGTG GGAGGCTGTT TCAGTAAAAG GAGGATACAA GCAGAAGTGG<br>13051 AGTACTAGAG GTGATGGGCT CCCAAAAGAT ACCCGAATTT CAGACTCCTT<br>13101 GGCCCCAATC GGGAACTGGA TCAGATCTCT GGAATTGGTC CGAAACCAAG<br>13151 TTCGTCTAAA TCCATTCAAT GAGATCTTGT TCAATCAGCT ATGTCGTACA<br>13201 GTGGATAATC ATTTGAAATG GTCAAATTTG CGAAGAAACA CAGGAATGAT<br>13251 TGAATGGATC AATAGACGAA TTTCAAAAGA AGACCGGTCT ATACTGATGT<br>13301 TGAAGAGTGA CCTACACGAG GAAAACTCTT GGAGAGATTA AAAAATCATG<br>13351 AGGAGACTCC AAACTTTAAG TATGAAAAAA ACTTTGATCC TTAAGACCCT<br>13401 CTTGTGGTTT TTATTTTTTA TCTGGTTTTG TGGTCTTCGT | |
| Amino acid sequence for VSV-N protein in rVSVΔG-SARS-CoV-2 clones MB1 and MB2, and Vectors A and B | Please see FIGS. 21B, 22B, 23B, and 24B. | 155 |
| Amino acid sequence for VSV-P protein in rVSVΔG-SARS-CoV-2 clones MB1 and MB2, and Vectors A and B | Please see FIGS. 21C, 22C, 23C, and 24C. | 156 |
| Amino acid sequence for VSV-M protein in rVSVΔG-SARS-CoV-2 clone MB2, and Vectors A and B | Please see FIGS. 21D, 22D, and 23D. | 157 |
| Amino acid sequence for SARS-CoV-2 S protein in rVSVΔG-SARS-CoV-2 clone MB2 | Please see FIG. 21E. | 158 |
| Nucleotide sequence for rVSVΔG-SARS-CoV-2 with codon-optimized, wild-type | 1 acgaagacaa acaaaccatt attatcatta aaaggctcag gagaaacttt aacagtaatc<br>61 aaaatgtctg ttacagtcaa gagaatcatt gacaacacag tcgtagttcc aaaacttcct<br>121 gcaaatgagg atccagtgga atacccggca gattacttca gaaaatcaaa ggagattcct | 159 |

TABLE 1-continued

Description of the Sequences

| Description | Sequences | SEQ ID NO |
|---|---|---|
| S protein | 181 ctttacatca atactacaaa aagtttgtca gatctaagag gatatgtcta ccaaggcctc<br>241 aaatccggaa atgtatcaat catacatgtc aacagctact tgtatggagc attaaaggac<br>301 atccggggta agttggataa agattggtca agtttcggaa taaacatcgg gaaagcaggg<br>361 gatacaatcg gaatatttga ccttgtatcc ttgaaagccc tggacggcgt acttccagat<br>421 ggagtatcgg atgcttccga aaccagcgca gatgacaaat ggttgccttt gtatctactt<br>481 ggcttataca gagtgggcag aacacaaatg cctgaataca gaaaaaagct catggatggg<br>541 ctgacaaatc aatgcaaaat gatcaatgaa cagtttgaac ctcttgtgcc agaaggtcgt<br>601 gacatttttg atgtgtgggg aaatgacagt aattacacaa aaattgtcgc tgcagtggac<br>661 atgttcttcc acatgttcaa aaaacatgaa tgtgcctcgt tcagatacgg aactattgtt<br>721 tccagattca aagattgtgc tgcattggca acatttggac acctctgcaa aataaccgga<br>781 atgtctacag aagatgtaac gacctggatc ttgaaccgag aagttgcaga tgaaatggtc<br>841 caaatgatgc ttccaggcca agaaattgac aaggccgatt catacatgcc ttatttgatc<br>901 gactttggat tgtcttctaa gtctccatat tcttccgtca aaaaccctgc cttccacttc<br>961 tgggggcaat tgacagctct tctgctcaga tccaccagag caaggaatgc ccgacagcct<br>1021 gatgacattg agtatacatc tcttactaca gcaggtttgt tgtacgctta tgcagtagga<br>1081 tcctctgccg acttggcaca acagttttgt gttggagata acaaatacac tccagatgat<br>1141 agtaccggag gattgacgac taatgcaccg ccacaaggca gagatgtggt cgaatggctc<br>1201 ggatggtttg aagatcaaaa cagaaaaccg actcctgata tgatgcagta tgcgaaaaga<br>1261 gcagtcatgt cactgcaagg cctaagagag aagacaattg gcaagtatgc gcaagtcagaa<br>1321 tttgacaaat gaccctataa ttctcagatc acctattata tattatgcta catatgaaaa<br>1381 aaactaacag atatcatgga taatctcaca aaagttcgtg agtatctcaa gtcctattct<br>1441 cgtctggatc aggcggtagg agagatagat gagatcgaag cacaacgagc tgaaaagtcc<br>1501 aattatgagt tgttccaaga ggatggagtg gaagagcata ctaagccctc ttatttcag<br>1561 gcagcagatg attctgacac agaatctgaa ccagaaattg aagacaatca aggcttgtat<br>1621 gcaccagatc cagaagctga gcaagttgaa ggctttatac aggggccttt agatgactat<br>1681 gcagatgagg aagtggatgt tgtatttact tcggactgga acagcctga gcttgaatct<br>1741 gacgagcatg gaaagacctt acggttgaca tcgccagagg gtttaagtgg agagcagaaa<br>1801 tcccagtggc tttcgacgat taaagcagtc gtgcaaagtg ccaaatactg gaatctggca<br>1861 gagtgcacat ttgaagcatc gggagaaggg gtcattatga aggagcgcca gataactccg<br>1921 gatgtatata aggtcactcc agtgatgaac acacatccgt cccaatcaga agcagtatca<br>1981 gatgtttggt ctctctcaaa gacatccatg actttccaac ccaagaaagc aagtcttcag<br>2041 cctctcacca tatccttgga tgaattgttc tcatctagag gagagttcat ctctgtcgga<br>2101 ggtgacggac gaatgtctca taaagaggcc atcctgctcg gcctgagata caaaaagttg<br>2161 tacaatcagg cgagagtcaa atattctctg tagactatga aaaaagtaa cagatatcac<br>2221 gatctaagtg ttatcccaat ccattcatca tgagttcctt aaagaagatt ctcggtctga<br>2281 aggggaaagg taagaaatct aagaaattag ggatcgcacc accccttat gaagaggaca<br>2341 ctagcatgga gtatgctccg agcgctccaa ttgacaaatc ctattttgga gttgacgaga<br>2401 tggacaccta tgatccgaat caattaagat atgagaaatt cttcttaca gtgaaaatga<br>2461 cggttagatc taatcgtccg ttcagaacat actcagatgt ggcagccgct gtatcccatt<br>2521 gggatcacat gtacatcgga atggcaggga aacgtccctt ctacaaaatc ttggcttttt<br>2581 tgggttcttc taatctaaag gccactccag cggtattggc agatcaaggt caaccagagt<br>2641 atcacgctca ctgcgaaggc agggcttatt tgccacatag gatggggaag accctccca<br>2701 tgctcaatgt accagagcac ttcagaagac cattcaatat aggtctttac aagggaacga<br>2761 ttgagctcac aatgaccatc tacgatgatg agtcagtaga agcagctcct atgatctggg<br>2821 atcatttcaa ttccttccaa ttttctgatt tcagagagaa ggccttaatg tttggcctga<br>2881 ttgtcgagaa aaaggcatct ggagcgtggg tcctggactc tatcggccac ttcaaatgag<br>2941 ctagtctaac ttctagcttc tgaacaatcc ccggtttact cagtctcccc taattccagc<br>3001 ctctcgaaca actaatatcc tgtcttttct atccctatga aaaaactaa cagagatcga<br>3061 tctgtttacg cgctagtgga tcctactcga gaggagccac catgttcgtg ttcctggtgc<br>3121 tattacctct ggtttcgtct caatgcgtaa accttacaac tagaactcag cttcctccag<br>3181 catacacaaa ttccttcact cgcggagtgt attatcctga taaggtctttt cgatcatcag<br>3241 tgttgcattc cacccaggat ttgtttctcc cgttctttc aaatgtaact tggttccatg<br>3301 ctatacatgt ttccggaacc aatggaacaa agagatttga taacccagtg ttaccattta<br>3361 acgacggagt ttatttcgca tcaactgaga aatccaatat cattagaggc tggatttcg<br>3421 gaacgaccct ggattctaaa acgcaatcct tgctgattgt taataatgca caaatgtgg<br>3481 tcattaaagt ctgtgaattc caattttgca atgatccatt tctcggcgtc tattaccaca<br>3541 agaataacaa atcttggatg gagtcaggat tcagggttta tagttccgca aataattgta<br>3601 cttttgaata cgtttcccaa ccattcttaa tggacttgga gggaaaacag ggaaatttta<br>3661 agaatctaag agaattcgtc tttaagaata ttgatggata tttcaagatc tattcaaaac<br>3721 atacacctat aaacctagtt agagatctcc cgcaagggtt ttcagcccta gagccactag<br>3781 ttgacctgcc aattggtatc aacattacga gattccagac cctactcgct ctgcatcggt<br>3841 catatttgac accaggagat tcatcgtcag gatggaccgc tggagcagct gcttactatg<br>3901 ttgggtatct gcaacctaga acatttctcc taaagtataa tgaaaacggg actattacag<br>3961 acgcagtcga ttgcgcactg gatccactct cagagacaaa gtgcactcta aaatcattca<br>4021 ctgtcgagaa aggaatctat caaacatcaa atttcagggt ccagccaact gagagtattg<br>4081 tccggttccc taacataact aacttgtgcc ccttcggaga ggttttcaat gctactcggt<br>4141 tcgccagcgt ctacgcatga acagaaaga ggatttcaaa ctgtgtcgca gattatagcg<br>4201 tcctctataa ttcagcatca ttcagtacat ttaaatgcta tggtgtcagc cccaccaaac<br>4261 ttaatgactt atgttttacc aatgtatatg cagttcctt tgtaatcaga ggtgacgaag<br>4321 tgaggcaaat cgcacctgga cagaccggaa agattgctga ttataattat aaactccctg<br>4381 atgattttac cggatgtgtt attgcttgga acagcaataa cctcgatagt aaggtcggag<br>4441 gaaactataa ctatttgtac agactgttta aaagtcgaa tttgaaccct tttgaagag<br>4501 acatatccac cgagatttac caggcgggca gcacacctgt aatggtgta gaaggattca<br>4561 attgttactt tccccctgca tcatatgggt ttcaaccaac caatggagtc ggatatcaac | |

TABLE 1-continued

Description of the Sequences

| Description | Sequences | SEQ ID NO |
|---|---|---|
| | 4621 catatcgtgt cgtcgtcctt tccttcgagc tgcttcatgc accagctaca gtctgcggac | |
| | 4681 ctaagaagag cactaatctt gtcaagaaca aatgtgtgaa ctttaatttt aatggattaa | |
| | 4741 caggaaccgg agttttgacc gagagtaata agaagttctt gccgttccag caatttggac | |
| | 4801 gagacattgc tgacaccaca gatgcggttc gtgacccgca aactttagag atcctagaca | |
| | 4861 tcaccccatg ttcattcggt ggagtttccg ttattactcc tggaacgaat acaagcaatc | |
| | 4921 aagttgccgt tctctatcaa gatgttaatt gtacagaagt gcctgtggcc attcatgcag | |
| | 4981 atcaactaac accaacttgg agagtttaca gcactgggtc caatgtcttc caaacgcgcg | |
| | 5041 ccggctgcct cattggtgca gaacatgtga ataactcata cgaatgtgac attccaatcg | |
| | 5101 gtgccggcat atgcgcctct taccagactc agactaattc gccaagaaga gccaggtctg | |
| | 5161 tcgcaagtca gtcaattatt gcatacacaa tgtcgttagg agcagagaat agtgtagcat | |
| | 5221 actcaaacaa ttctatagca ataccatacca acttcactat atcagtaact acagaaatat | |
| | 5281 tgccagtatc catgactaaa acaagtgtgg attgcaccat gtacatctgt ggagattcca | |
| | 5341 cagaatgcag caatcttctc ttgcaatacg gatcattctg cacacaactg aatagggcac | |
| | 5401 tgactggaat tgcagtcgag caggataaga acacacagga ggtgtttgcc caagtcaaac | |
| | 5461 aaatatacaa aacaccaccc atcaaggatt ttggaggatt taatttctca caaatactcc | |
| | 5521 ccgacccatc caagccctcc aaaaggagtt tcattgagga cctcttgttt aataaggtta | |
| | 5581 ccttggcaga tgccgggttt attaagcagt acggcgactg tcttggagac atagcagcca | |
| | 5641 gagatctaat ttgtgcccag aaattcaatg gactgacagt cctgcctccc ttattaactg | |
| | 5701 atgagatgat agctcagtat acatcagcat tgttggctgg tacaattaca tctggatgga | |
| | 5761 catttggtgc cggagcggca ttacaaatcc cttttgcaat gcaaatggcc tatagattta | |
| | 5821 atggaatcgg agtaactcaa aatgttttat atgagaatca gaaattaatt gcaaatcaat | |
| | 5881 tcaattcagc tataggaaag attcaggatt cactcagtag tacagcaagc gctctaggca | |
| | 5941 aattacaaga cgtcgtcaat cagaatgcac aggcattaaa tacactggtg aagcaattga | |
| | 6001 gttccaattt cggagcaatt tcatctgttc taatgatat attgtcagaa ctggataaag | |
| | 6061 tagaagccga ggtccaaatc gataggctga tcacaggaag acttcaatca ctacagacat | |
| | 6121 acgtcaccca acaactcatc agagcagcag aaattagagc ctctgctaat ctagccgcaa | |
| | 6181 caaagatgtc agagtgcgta ttgggacaat ctaagagggt cgacttttgt ggaaagggt | |
| | 6241 atcacttgat gtcctttcct caatctgcac cacacgagt tgtcttctta catgtaacat | |
| | 6301 atgtgcccgc tcaagaaaag aatttcacta cagcacctgc aatatgtcat gacggaaaag | |
| | 6361 cacattttcc tcgggaggga gttttcgttt ctaatggaac ccattggttc gtgacccaaa | |
| | 6421 ggaacttta cgagcctcaa ataattacaa ctgataatac attcgtttct ggaaattgcg | |
| | 6481 acgtagttat aggtattgta aataatactg tttatgaccc tttacaacct gaactcgatt | |
| | 6541 ccttcaagga agaactcgac aaatatttta agaatcacac ctcaccggac gttgacttag | |
| | 6601 gagacatttc cgggattaac gctagtgtag tcaatatcca aaaggagata gatagactga | |
| | 6661 atgaggtagc aaagaatctt aatgaatctt tgatcgacct tcaggagctg gggaagtacg | |
| | 6721 aacaatacat aaaatggcca tggtacatct ggctcgggtt tattgctgga ctaattgcaa | |
| | 6781 tagtcatggt cactatcatg ctgtgttgta tgacatcgtg ctgctcatgc ctcaagggat | |
| | 6841 gttgtagctg tggatcttgt tgcaagttcg atgaggatga ttcagaacca gttttaaaag | |
| | 6901 gagtaaagtt gcattacaca taaaggctag ctgtttacgc gttatccatg ctcaaagagg | |
| | 6961 cctcaattat atttgagttt ttaattttta tgaaaaaaaa ctaacagcaa tcatggaagt | |
| | 7021 ccacgatttt gagaccgacg agttcaatga tttcaatgaa gatgactatg ccacaagaga | |
| | 7081 attcctgaat cccgatgagc gcatgacgta cttgaatcat gctgattaca acctgaattc | |
| | 7141 tcctctaatt agtgatgata ttgacaattt aatcaggaaa ttcaattctc ttccaattcc | |
| | 7201 ctcgatgtgg gatagtaaga actgggatag agttcttgag atgttaacgt catgtcaagc | |
| | 7261 caatcccatc ccaacatctc agatgcataa atggatggga agttggttaa tgtctgataa | |
| | 7321 tcatgatgcc agtcaagggt atagttttt acatgaagtg gacaaagagg cagaaataac | |
| | 7381 atttgacgtg gtggagacct catccgcgg ctggggcaac aaaccaattg aatacatcaa | |
| | 7441 aaaggaaaga tggactgact cattcaaaat tctcgcttat ttgtgtcaaa agttttttga | |
| | 7501 cttacacaag ttgacattaa tcttaaatgc tgtctctgag gtggaattgc tcaacttggc | |
| | 7561 gaggacttc aaaggcaaag tcagaagaag ttctcatgga acgaacatat gcaggattag | |
| | 7621 ggttcccagc ttgggtccta ctttttattc agaaggatgg gcttacttca agaaacttga | |
| | 7681 tattctaatg gaccgaaact ttctgttaat ggtcaaagat gtgattatag ggaggatgca | |
| | 7741 aacggtgcta tccatggtat gtagaatgaa caacctgttc tcagagcaag acatcttctc | |
| | 7801 ccttctaaat atctacagaa ttggagataa aattgtggag aggcagggaa attttctta | |
| | 7861 tgacttgatt aaaatggtgg aaccgatatg caacttgaag ctgatgaaat tagcaagaga | |
| | 7921 atcaaggcct ttagtccac aattccctca ttttgaaaat catatcaaga cttctgttga | |
| | 7981 tgaaggggca aaaattgacc gaggtataag attcctccat gatcagataa tgagtgtgaa | |
| | 8041 aacagtggat ctcacactgg tgatttatgg atcgttcaga cattggggtc atccttttat | |
| | 8101 agattattac actggactag aaaaattaca ttcccaagta accatgaaga aagatattga | |
| | 8161 tgtgtcatat gcaaagcac ttgcaagtga tttagctcgg attgttctat ttcaacagtt | |
| | 8221 caatgatcat aaaaagtgat tcgtgaatgg agacttgctc cctcatgatc atcccttaa | |
| | 8281 aagtcatgtt aaagaaaata catggcccac agctgctcaa gttcaagatt ttgagataaa | |
| | 8341 atggcatgaa cttccgctga ttaaatgttt tgaaatacc gacttactag acccatcgat | |
| | 8401 aatatactct gacaaaagtc attcaatgaa taggtcagag gtgttgaaac atgtccgaat | |
| | 8461 gaatccgaac actcctatcc ctagtaaaaa ggtgttgcag actatgttgg acacaaaggc | |
| | 8521 taccaattgg aaagaatttc ttaaagagat tgatgagaag ggcttagatg atgatgatct | |
| | 8581 aattattggt cttaaaggaa aggagaggga actgaagttg gcaggtagat ttttctccct | |
| | 8641 aatgtcttgg aaattgcgag aatactttgt aattaccgaa tatttgataa agactcattt | |
| | 8701 cgtccctatg tttaaaggcc tgacaatggc ggacgatcta actgcagtca ttaaaagat | |
| | 8761 gttagattcc tcatccgcc aaggattgaa gtcatatgag gcaatttgta tagccaatca | |
| | 8821 cattgattac gaaaaatgga ataaccacca aggaagtta tcaaacggcc cagtgttccg | |
| | 8881 agttatgggc cagttcttag gttatccatc cttaatcgag agaactcatg aatttttga | |
| | 8941 gaaaagtctt atatactaca atggaagacc agacttgatg cgtgttcaca caacacact | |
| | 9001 gatcaattca acctcccaac gagtttgttg gcaaggacaa gagggtggac tggaaggtct | |

TABLE 1-continued

Description of the Sequences

| Description | Sequences | SEQ ID NO |
|---|---|---|
| | 9061 acggcaaaaa ggatggagta tcctcaatct actggttatt caaagagagg ctaaaatcag | |
| | 9121 aaacactgct gtcaaagtct tggcacaagg tgataatcaa gttatttgca cacagtataa | |
| | 9181 aacgaagaaa tcgagaaacg ttgtagaatt acagggtgct ctcaatcaaa tggtttctaa | |
| | 9241 taatgagaaa attatgactg caatcaaaat agggacaggg aagttaggac ttttgataaa | |
| | 9301 tgacgatgag actatgcaat ctgcagatta cttgaattat ggaaaaatac cgattttccg | |
| | 9361 tggagtgatt agagggttag agaccaagag atggtcacga gtgacttgtg tcaccaatga | |
| | 9421 ccaaatacccc acttgtgcta atataatgag ctcagtttcc acaaatgctc tcaccgtagc | |
| | 9481 tcattttgct gagaacccaa tcaatgccat gatacagtac aattattttg ggacatttgc | |
| | 9541 tagactcttg ttgatgatgc atgatcctgc tcttcgtcaa tcattgtatg aagttcaaga | |
| | 9601 taagatacca ggcttgcaca gttctacttt caaatacgcc atgttgtatt tggacccttc | |
| | 9661 cattggagga gtgtcgggca tgtcttttgtc caggttttttg attagagcct tcccagatcc | |
| | 9721 cgtaacagaa agtctctcat tctggagatt catccatgta catgctcgaa gtgagcatct | |
| | 9781 gaaggagatg agtgcagtat ttggaaaccc cgagatagcc aagtttcgaa taactcacat | |
| | 9841 agacaagcta gtagaagatc caacctctct gaacatcgct atgggaatga gtccagcgaa | |
| | 9901 cttgttaaag actgaggtta aaaaatgctt aatcgaatca agacaaacca tcaggaacca | |
| | 9961 ggtgattaag gatgcaacca tatatttgta tcatgaagag gatcggctca gaagtttctt | |
| | 10021 atggtcaata aatcctctgt tccctagatt tttaagtgaa ttcaaatcag gcacttttttt | |
| | 10081 gggagtcgca gacgggctca tcagtctatt tcaaaattct cgtactattc ggaactcctt | |
| | 10141 taagaaaaag tatcataggg aattggatga tttgattgtg aggagtgagg tatcctcttt | |
| | 10201 gacacattta gggaaacttc atttgagaag gggatcatgt aaaatgtgga catgttcagc | |
| | 10261 tactcatgct gacacattaa gatacaaatc ctggggccgt acagttattg ggacaactgt | |
| | 10321 accccatcca ttagaaatgt tgggtccaca acatcgaaaa gagactcctt gtgcaccatg | |
| | 10381 taacacatca gggttcaatt atgtttctgt gcattgtcca gacgggatcc atgacgtctt | |
| | 10441 tagttccacgg ggaccattgc ctgcttatct agggtctaaa acatctgaat ctacatctat | |
| | 10501 tttgcagcct tgggaaaggg aaagcaaagt cccactgatt aaaagagcta cacgtcttag | |
| | 10561 agatgctatc tcttggtttg ttgaacccga ctctaaaacta gcaatgacta tactttctaa | |
| | 10621 catccactct ttaacaggcg aagaatggac caaaaggcag catgggttca aaagaacagg | |
| | 10681 gtctgcccct cataggtttt cgacatctcg gatgagccat ggtgggttcg catctcagag | |
| | 10741 cactgcagca ttgaccaggt tgatggcaac tacagacacc atgagggatc tgggagatca | |
| | 10801 gaatttcgac tttttattcc aagcaacgtt gctctatgct caaattacca ccactgttgc | |
| | 10861 aagagacgga tggatcacca gttgtacaga tcattatcat attgcctgta agtcctgttt | |
| | 10921 gagacccata gaagagatca ccctggactc aagtatggac tacacgcccc cagatgtatc | |
| | 10981 ccatgtgctg aagacatgga ggaatgggga aggttcgtgg ggacaagaga taaaacagat | |
| | 11041 ctatccttta gaagggaatt ggaagaattt agcacctgct gagcaatcct atcaagtcgg | |
| | 11101 cagatgtata ggttttctat atggagactt ggcgtataga aaatctactc atgccgagga | |
| | 11161 cagttctcta tttcctctat ctatacaagg tcgtattaga ggtcgaggtt tcttaaaagg | |
| | 11221 gttgctagac ggattaatga gagcaagttg ctgccaagta atacaccgga gaagtctggc | |
| | 11281 tcatttgaag aggccggcca acgcagtgta cggaggtttg atttacttga ttgataaatt | |
| | 11341 gagtgtatca cctccattcc tttctcttac tagatcagga cctattagag acgaattaga | |
| | 11401 aacgattccc cacaagatcc caactcccta tccgacaagc aaccgtgata tgggggtgat | |
| | 11461 tgtcagaaat tacttcaaat accaatgccg tctaattgaa aagggaaaat acagatcaca | |
| | 11521 ttattcacaa ttatggttat tctcagatgt cttatccata gacttcattg gaccattctc | |
| | 11581 tatttccacc accctcttgc aaatcctata caagccattt ttatctggga aagataagaa | |
| | 11641 tgagttgaga gagctggcaa atcttttcttc attgctaaga tcaggagagg ggtgggaaga | |
| | 11701 catacatgtg aaattcttca ccaaggacat attattgtgt ccagagaaa tcagacatgc | |
| | 11761 ttgcaagttc gggattgcta aggataataa taagacatg agctatcccc cttggggaag | |
| | 11821 ggaatccaga gggacaatta caacaatccc tgtttattat acgaccaccc cttacccaaa | |
| | 11881 gatgctagag atgcctccaa gaatccaaaa tcccctgctg tccggaatca ggttgggcca | |
| | 11941 attaccaact ggcgctcatt ataaaattcg gagtatatta catggaatgg gaatccatta | |
| | 12001 cagggacttc ttgagttgtg gagacggctc cggagggatg actgctgcat tactacgaga | |
| | 12061 aaatgtgcat agcagaggaa tattcaatag tctgttagaa ttatcagggt cagtcatgcg | |
| | 12121 aggcgcctct cctgagcccc ccagtgccct agaaacttta ggaggagata aatcgagatg | |
| | 12181 tgtaaatggt gaaacatgtt gggaatatcc atctgactta tgtgacccaa ggacttggga | |
| | 12241 ctatttcctc cgactcaaag caggcttggg gcttcaaatt gatttaattg taatggatat | |
| | 12301 ggaagttcgg gattcttcta ctagcctgaa aattgagacg aatgttagaa attatgtgca | |
| | 12361 ccggattttg gatgagcaag gagttttaat ctacaagact tatgaacat atatttgtga | |
| | 12421 gagcgaaaag aatgcagtaa caatccttgg tccatgttc aagacggtcg acttagttca | |
| | 12481 aacagaattt agtagttctc aaacgtctga agtatatatg gtatgtaaag gtttgaagaa | |
| | 12541 attaatcgat gaacccaatc ccgattggtc ttccatcaat gaatcctgga aaaacctgta | |
| | 12601 cgcattccag tcatcagaac aggaatttgc cagagcaaag aaggttagta catactttac | |
| | 12661 cttgacaggt attccctccc aattcattcc tgatcctttt gtaaacattg agactatgct | |
| | 12721 acaaatattc ggagtaccca cgggtgtgtc tcatgcggct gccttaaaat catctgatag | |
| | 12781 acctgcagat ttattgacca ttagccttttt ttatatggcg attatatcgt attataacat | |
| | 12841 caatcatatc agagtaggac cgatacctcc gaacccccca tcagatggaa ttgcacaaaa | |
| | 12901 tgtggggatc gctataactg gtataagctt ttggctgagt ttgatggaga aagacattcc | |
| | 12961 actatatcaa cagtgtttag cagttatcca gcaatcattc ccgattaggt gggaggctgt | |
| | 13021 ttcagtaaaa ggaggataca agcagaagtg gagtactaga ggtgatgggc tcccaaaaga | |
| | 13081 taccgaatt tcagactcct tggccccaat cgggaactgg atcagatctc tggaattggt | |
| | 13141 ccgaaaccaa gttcgtctaa atccattcaa tgagatcttta ttcaatcagc tatgtcgtac | |
| | 13201 agtggataat catttgaaat ggtcaaattt gcgaagaaac acaggaatga ttgaatggat | |
| | 13261 caatagacga atttcaaaag aagaccggtc tatactgatg ttgaagagtg acctacacga | |
| | 13321 ggaaaactct tggagagatt aaaaaatcat gaggagactc caaacttttaa gtatgaaaaa | |
| | 13381 aactttgatc cttaagaccc tcttgtggtt tttatttttt atctggttttt gtggtcttcg | |
| | 13441 t | |

TABLE 1-continued

Description of the Sequences

| Description | Sequences | SEQ ID NO |
|---|---|---|
| Nucleotide sequence for Vector A, which is a VSV vector without the VSV-G gene. | Please see FIG. 22F. | 160 |
| Nucleotide sequence for Vector B, which is a VSV vector without the VSV-G gene. | Please see FIG. 23F. | 161 |
| Amino acid sequence of the signal sequence (SS) of SEQ ID NOS: 1, 4, 7, 10, 13, 16, 19, and 22 | mfvflvllplvssqc | 162 |
| Amino acid sequence of the membrane-proximal external region (MPER) of SEQ ID NOS: 1, 4, 7, 10, and 16 | yeqyikwpwyiw | 163 |
| Amino acid sequence of the transmembrane region (TM) of SEQ ID NOS: 1, 4, 7, and 16 | lgfiagliaivmvtiml | 164 |
| Amino acid sequence of the cytoplasmic tail (CT) of SEQ ID NO: 1 | ccmtsccsclkgccscgscckfdeddsepvlkgvklhyt | 165 |
| Kozak sequence of SEQ ID NOS: 2, 3, 5, 6, 8, 9, 11, 12, 14, 15, 17, 18, 20, 21, 23, and 24 | aggagccacc | 166 |
| Nucleotide sequence encoding the SS of SEQ ID NOS: 2, 3, 5, 6, 8, 9, 11, 12, 14, 15, 17, 18, 20, 21, 23, and 24 | atgttcgtgttcctggtgctattacctctggtttcgtctcaatgc | 167 |
| Nucleotide sequence encoding the MPER of SEQ ID NOS: 2, 3, 5, 6, 8, 9, 11, 12, 17, and 18 | tacgaacaatacataaaatggccatggtacatttgg | 168 |
| Nucleotide sequence encoding the TM of SEQ ID NOS: 2, 3, 5, 6, 8, 9, 17, and 18 | ctcgggtttattgctggactaattgcaatagtcatggtcactatcatgctg | 169 |
| Nucleotide sequence encoding the CT of SEQ ID NOS: 2 and 3 | tgttgtatgacatcgtgctgctcatgcctcaagggatgttgtagctgtggatcttgttgcaagttcg atgaggatgattcagaaccagttttaaaaggagtaaagttgcattacaca | 170 |
| Amino acid sequence of the CT of SEQ ID NO: 4 | ccmtsccs | 171 |
| Nucleotide sequence encoding the CT of SEQ ID NOS: 5 and 6 | tgttgtatgacatcgtgctgctca | 172 |
| Amino acid sequence of the Vector B VSV-G-CT IND serotype of SEQ ID NOS: 7, 10, 13, and 19 | rvgiylciklkhtkkrqiytdiemnrlgk | 173 |
| Nucleotide sequence encoding the Vector B VSV-G-CT IND serotype sequence of SEQ ID NOS: 8, 9, 11, 12, 14, 15, 20, and 21 | cgagttggtatttatctttgcattaaattaaagcacaccaagaaaagacagatttatacagacatag agatgaaccgacttggaaag | 174 |
| Amino acid sequence of the Vector B VSV-G-TM IND serotype of SEQ ID NOS: 10 and 13 | ssiasffffiigliiglflvl | 175 |

TABLE 1-continued

Description of the Sequences

| Description | Sequences | SEQ ID NO |
|---|---|---|
| Nucleotide sequence encoding the Vector B VSV-G-TM IND serotype sequence of SEQ ID NOS: 11, 12, 14, and 15 | agctctattgcctcttttttctttatcatagggttaatcattggactattcttggttctc | 176 |
| Amino acid sequence of the MPER of SEQ ID NOS: 13, 19, and 22 | yeqyik | 177 |
| Nucleotide sequence encoding the MPER of SEQ ID NOS: 14 and 15 | tacgaacaatacataaaa | 178 |
| Amino acid sequence of the CT of SEQ ID NO: 16 | ccmtsccsclkgccscgs | 179 |
| Nucleotide sequence encoding the CT of SEQ ID NOS: 17 and 18 | tgttgtatgacatcgtgctgctcatgcctcaagggatgttgtagctgtggatct | 180 |
| Amino acid sequence of the TM of SEQ ID NOS: 19 and 22 | WPWYIWLGFIAGLIAIVMVTIML | 181 |
| Amino acid sequence of the CT of SEQ ID NOS: 19 and 22 | CCMTSCCSCLKGCCSCGSCC | 182 |
| Nucleotide sequence encoding the TM of SEQ ID NOS: 20, 21, 23, and 24 | tggccatggtacatttggctcgggtttattgctggactaattgcaatagtcatggtcactatcatgctg | 183 |
| Nucleotide sequence encoding the CT of SEQ ID NOS: 20, 21, 23, and 24 | tgttgtatgacatcgtgctgctcatgcctcaagggatgttgtagctgtggatcttgttgc | 184 |
| Amino acid sequence for the Vector B VSV-G-CT IND serotype of SEQ ID NO: 22 | KLKHTKKRQIYTDIEMNRLGK | 185 |
| Nucleotide sequence encoding the Vector B VSV-G-CT IND serotype sequence of SEQ ID NO: 23 and 24 | aaattaaagcacaccaagaaaagacagatttatacagacatagagatgaaccgacttggaaag | 186 |
| VSV-G-TM-CT segment of Vector A | SSIASFFFII GLIIGLFLVL RVGIHLCIKL KHTKKRQIYT DIEMNRLGK | 187 |
| VSV-G-TM-CT segment of Vector B | SSIASFFFII GLIIGLFLVL RVGIYLCIKL KHTKKRQIYT DIEMNRLGK | 188 |
| Leader sequence 1 | NEVAKNLNESLIDLGELGK | 189 |
| Leader sequence 2 | TLFFGDTGLSKNPIEFVEGWFSSWK | 190 |
| A segment of VSV-G | TLFFGDTGLSKNPIEFVEGWFSSWKSSIASFFFTIGLIIGLFLVLRVGIYLCIKLKHTKKRQIYTDIEMNRLGK | 191 |
| Nucleotide sequence encoding the MPER of SEQ ID NOS: 20 and 23 | tacgaacaatacataaaa | 192 |
| A portion of the C-terminus of SARS-CoV-2 S protein | GSCCKFDEDDSEPVLKGVKLHYT | 193 |
| A SNP at position 6993 | gaaaaaaac | 194 |

BRIEF DESCRIPTION OF THE DRAWINGS

FIGS. 1A-1Y show amino acid and nucleotide sequences. 1A-1X show amino acid sequences and nucleotide sequences of Constructs 1-8 which are as follows: Construct 1: wild-type (wt) SARS-CoV-2 S protein (S_WILD-TYPE) (FIGS. 1A-C); Construct 2: SARS-CoV-2 S protein with CT deletion (S_ΔCT31) (FIGS. 1D-F); Construct 3: SARS-CoV-2 S protein with VSVG-CT Indiana (IND) serotype (S-VSV-Gct) (FIGS. 1G-I); Construct 4: SARS-CoV-2 S protein with VSVG-TM-CT IND serotype (S_VSV-Gtmct) (FIGS. 1J-L); Construct 5: SARS-CoV-2 S protein with MPER6aa and VSVG-TM-CT IND serotype (S_VSV_Gtm-ctαmper6) (FIGS. 1M-O); Construct 6: SARS-CoV-2 S protein with dCt21 (S_Δ21) (FIGS. 1P-R); Construct 7: SARS-CoV-2 S protein with dCt19 and VSVGct (S_ΔCT19_Gct) (FIGS. 1S-U); and Construct 8: SARS-CoV-2 S protein with dCt19 and VSVGct21 FIGS. 1(V-X). In FIG. 1G, the cytoplasmic tail of SARS-CoV-2 S protein is swapped with the VSV-G cytoplasmic tail. In FIG. 1J, the cytoplasmic tail and transmembrane domain of SARS-CoV-2 S protein are swapped with the cytoplasmic tail and transmembrane domain of VSV-G. FIG. 1Y shows comparison of Vector A and Vector B sequences for the VSVG-TM-CT segment. Vector A is based on GenBank Accession number EA043260. Vector B is based on GenBank MO746802 and was developed by modifying sequences in GenBank Accession number EF197793. While both Vectors A and B are of the VSV IND serotype, they have different amino acids at position 25. Vector A VSVG-TM-CT (SEQ ID NO: 187) comprises His25 (underlined) while Vector B VSVG-TM-CT (SEQ ID NO: 188) comprises Tyr25 (underlined). Vector B VSV-G-TM-CT (SEQ ID NO: 188) may also be found at amino acid position number 1218 to amino acid position number 1266 of SEQ ID NO: 10, and at amino acid position number 1212 to amino acid position number 1260 of SEQ ID NO: 13. WT, wild type; SS, signal peptide sequence; MPER, membrane-proximal external region; TM, transmembrane region; CT, cytoplasmic tail. The Kozak sequence is an additional 10 nucleotides before (i.e., 5' of) the start codon which may help control translation of the protein. Sequences are written from N-to-C terminus or 5' to 3', for amino acid or nucleic acid sequences, respectively.

Figure 2:
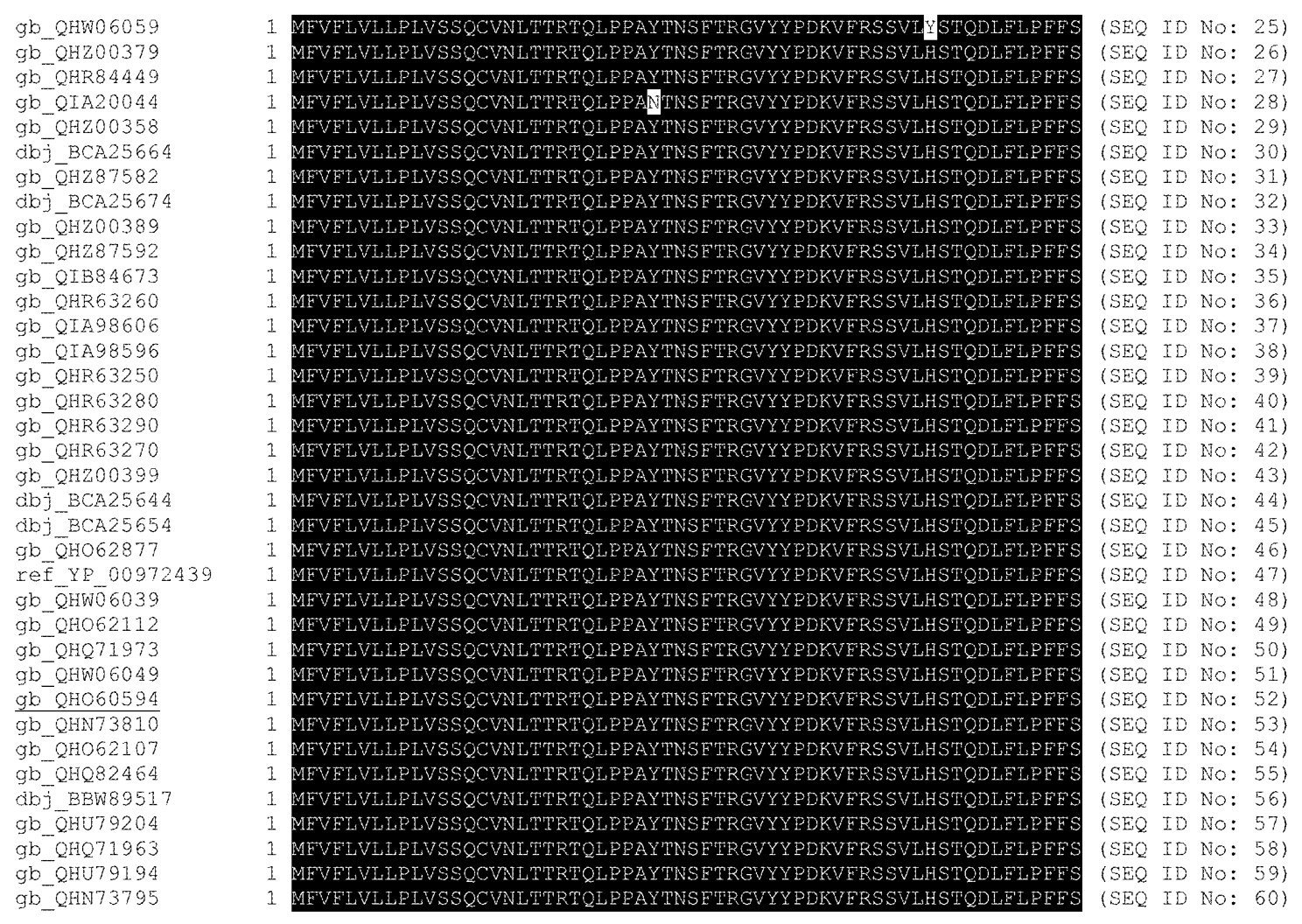
Figure 2:
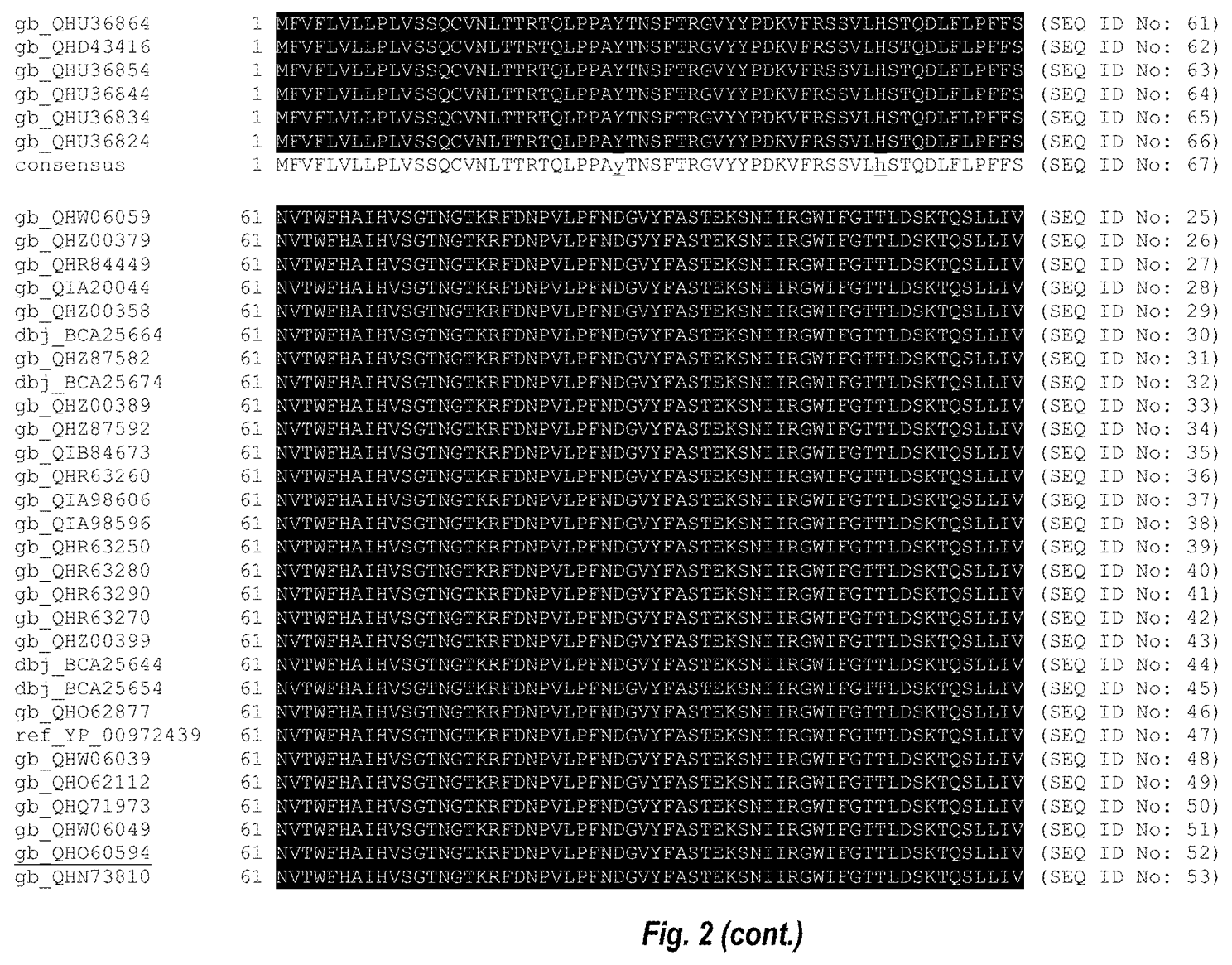
Figure 2:
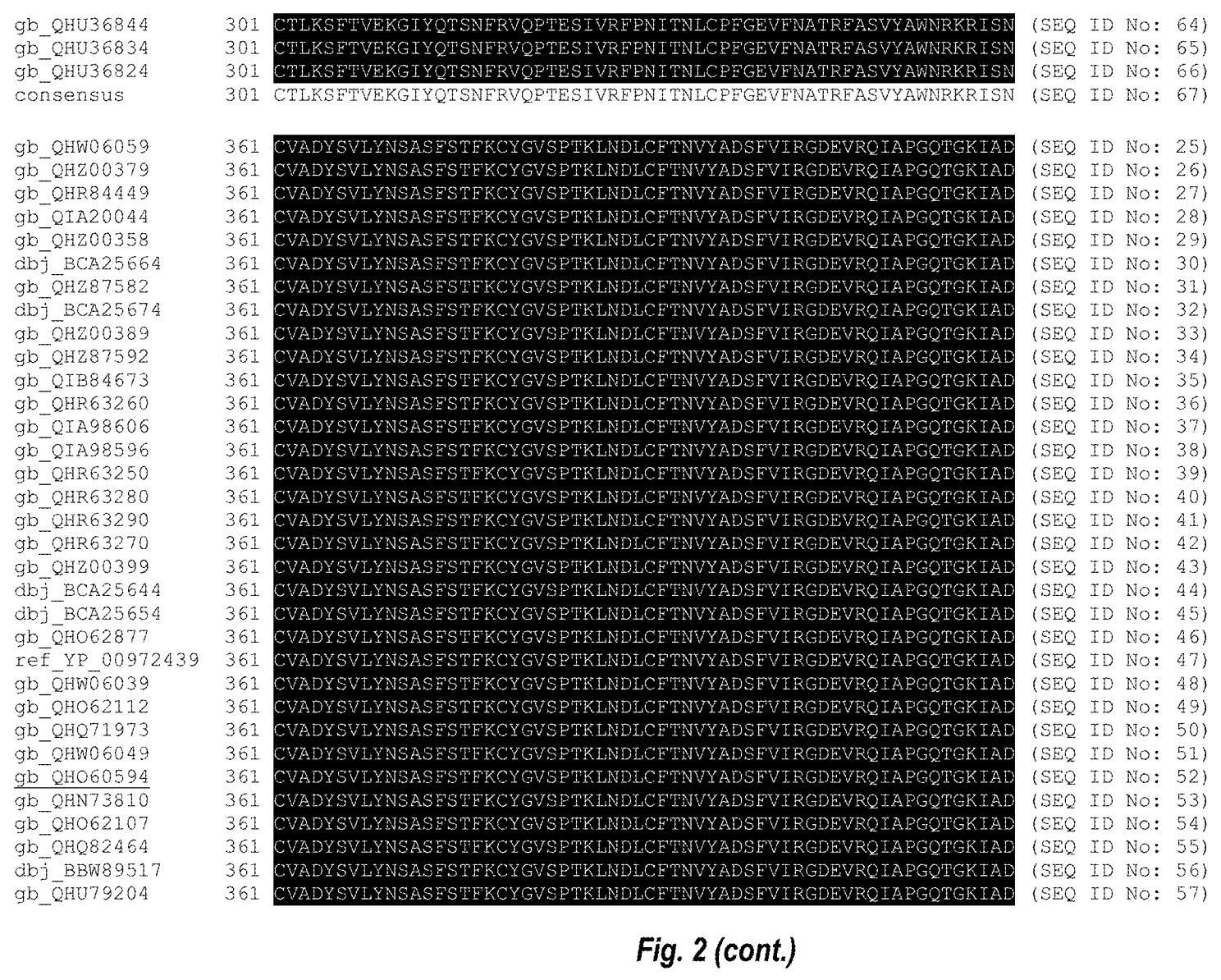
Figure 2:
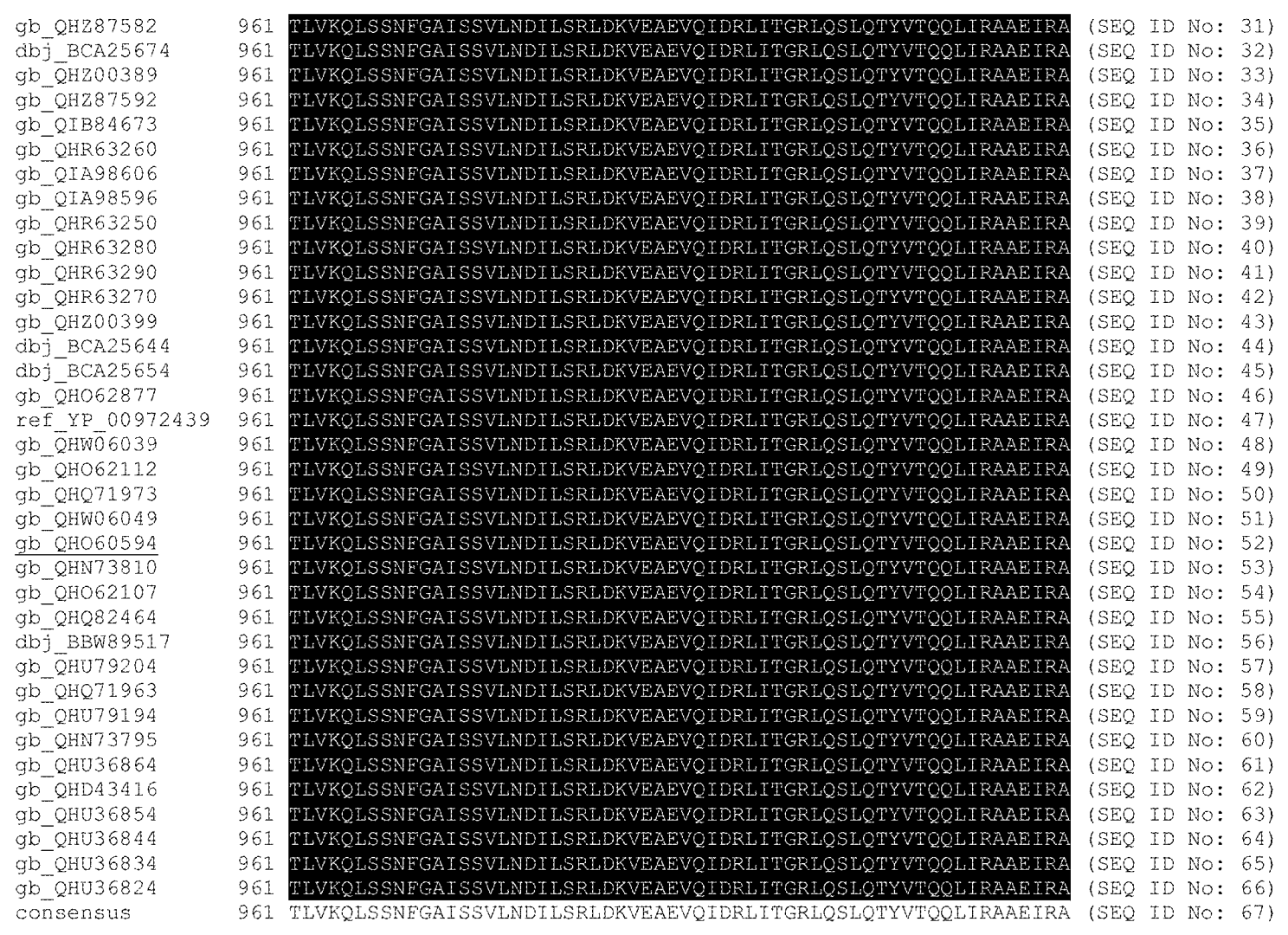
Figure 2:
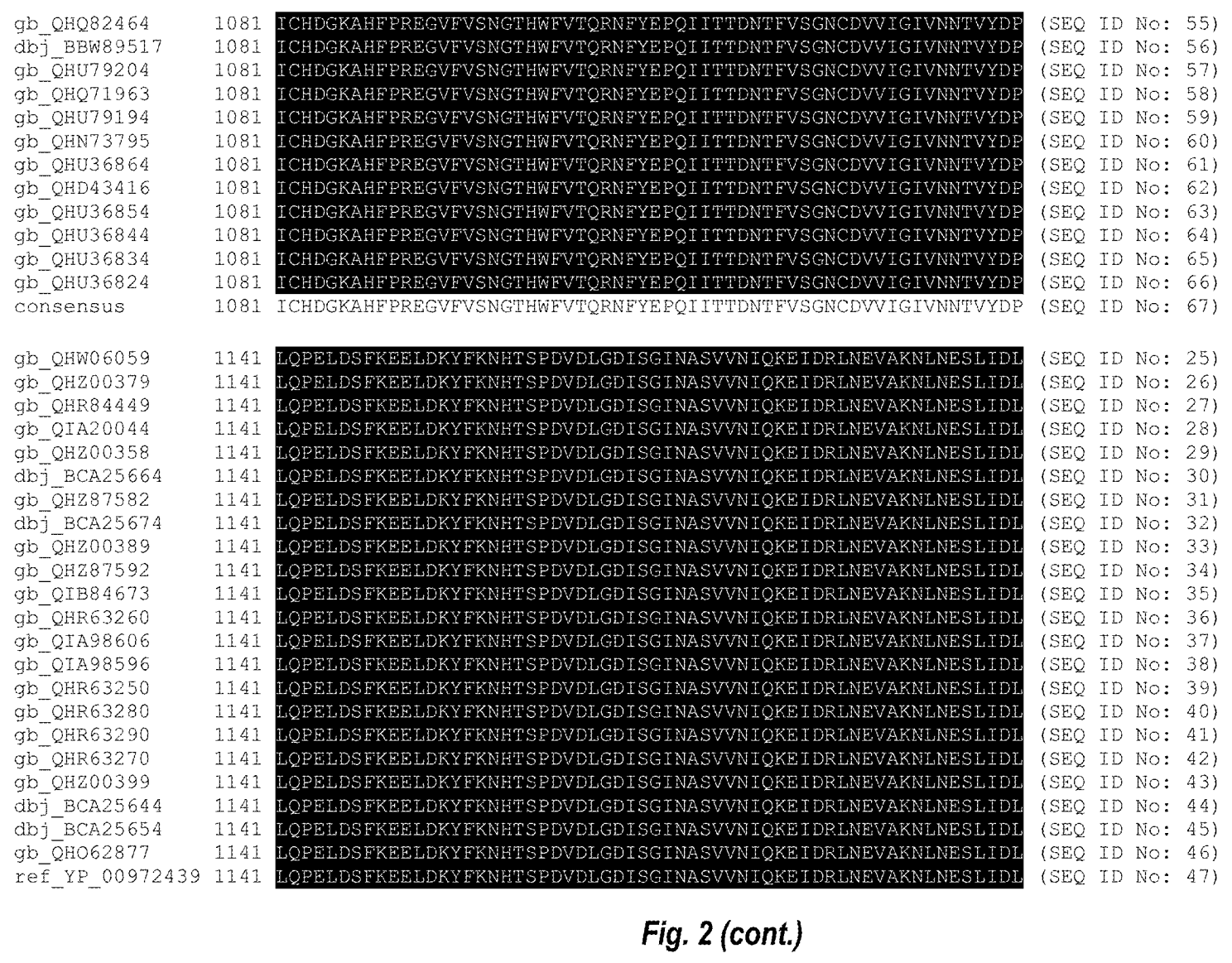

FIG. 2 shows alignment of 42 full-length SARS-CoV-2 S protein amino acid variant sequences. A consensus sequence is shown at the bottom of the alignment. The number on the left of each sequence is the GenBank Accession Number for the corresponding SARS-CoV-2 S protein. Sequences are written from N-to-C terminus. The nucleotide sequences for SARS-CoV-2 S protein variants shown here are incorporated by reference from Genbank. Point mutations within each variant are shown with black text and white highlight. Point mutations in the consensus sequence are shown in lowercase underlined. QHO60594 is the source sequence for SARS-CoV-2 S protein and is identified with an underline.

FIG. 4 illustrates rational design of a VSVΔG-SARS-CoV-2 recombinant viral particle, wherein the VSV glycoprotein (VSV-G) is replaced by SARS-CoV-2 S protein or variants thereof. S adaptive refers to SARS-CoV-2 S proteins that comprise adaptive mutations after passaging in the cells.

FIG. 5 shows SARS-CoV-2 S proteins inserted in the VSV genomic clone to produce Constructs 1-8 of FIG. 1. In Construct 1 SEQ ID NO: 1, the sequences of Leader Sequence 1 SEQ ID NO: 189, MPER SEQ ID NO: 163, TM SEQ ID NO: 164, and CT SEQ ID NO: 165 span from amino acid position nos. 1187-1273 of SEQ ID NO: 1. In Construct 2 SEQ ID NO: 4, the sequences of Leader Sequence 1 SEQ ID NO: 189, MPER SEQ ID NO: 163, TM SEQ ID NO: 164, and CT SEQ ID NO: 171 span from amino acid position nos. 1187-1242 of SEQ ID NO: 4. In Construct 3 SEQ ID NO: 7, the sequences of Leader Sequence 1 SEQ ID NO: 189, MPER SEQ ID NO: 163, TM SEQ ID NO: 164, and SEQ ID NO: 173 span from amino acid position nos. 1187-1263 of SEQ ID NO: 7. In Construct 4 SEQ ID NO: 10, the sequences of Leader Sequence 1 SEQ ID NO: 189, MPER SEQ ID NO: 163, SEQ ID NO: 175, and SEQ ID NO: 173 span from amino acid position nos. 1187-1266 of SEQ ID NO: 10. In Construct 5 SEQ ID NO: 13, the sequences of Leader Sequence 1 SEQ ID NO: 189, MPER SEQ ID NO: 177, SEQ ID NO: 175, and SEQ ID NO: 173 span from amino acid position nos. 1187-1260 of SEQ ID NO: 13. In Construct 6 SEQ ID NO: 16, the sequences of Leader Sequence 1 SEQ ID NO: 189, MPER SEQ ID NO: 163, TM SEQ ID NO: 164, and CT SEQ ID NO: 179 span from amino acid position nos. 1187-1252 of SEQ ID NO: 16. In Construct 7 SEQ ID NO: 19, the sequences of Leader Sequence 1 SEQ ID NO: 189, MPER SEQ ID NO: 177, TM SEQ ID NO: 181, CT SEQ ID NO: 182, and SEQ ID NO: 173 span from amino acid position nos. 1187-1283 of SEQ ID NO: 19. In Construct 8 SEQ ID NO: 22, the sequences of Leader Sequence 1 SEQ ID NO: 189, MPER SEQ ID NO: 177, TM SEQ ID NO: 181, CT SEQ ID NO: 182, and SEQ ID NO: 185 span from amino acid position nos. 1187-1275 of SEQ ID NO: 22. A segment of VSV-G with the sequence set forth in SEQ ID NO: 191 is also shown. In this VSV-G segment, the sequences of Leader Sequence 1, SEQ ID NO: 175, and SEQ ID NO: 173 span from amino acid position nos. 1-74 of SEQ ID NO: 191. Also in this VSV-G segment, the sequence of SEQ ID NO: 185 spans from amino acid position nos. 54-74 of SEQ ID NO: 191. SS, signal sequence; MPER, membrane-proximal external region; TM, transmembrane region; CT, cytoplasmic tail. Sequences in bold indicate inserted sequences that originate from VSV-G. S1 and S2 domains are shown, as well as the Furin cleavage site. Leader Sequence 1 is SEQ ID NO: 189. Leader Sequence 2 is SEQ ID NO: 190.

In FIG. 10A, clone isolates SF1 and SF2 showed reduction of S protein post-translational processing, indicative of a mutations, e.g., R683G, at the Furin cleavage site. FIGS. 10A-B show western blots for isolates cloned in serum-free medium. In FIG. 10B, the arrow marks the control lanes. FIG. 10C shows a western blot for isolates cloned in serum-containing medium.

FIG. 12 shows titers of two vaccine candidates, rVSVΔG-SARS-CoV-2 clones MB1 and MB2, in the cell culture medium after infection. These two vaccine candidates have been further tested in non-human primates (NHP) and small animal models. See Example 15 below. rVSVΔG-SARS-CoV-2 clone MB1 reached to higher titers than rVSVΔG-SARS-CoV-2 clone MB2 at all selected time points. For virus production purpose, the harvest time should occur from 54 to 65 hours post infection rVSVΔG-SARS-CoV-2 clone MB1 and 72 h post infection for rVSVΔG-SARS-CoV-2 clone MB2.

FIG. 14A shows passage 4 (P4) at 43 hours post infection. FIG. 14B shows passage 11 (P11) at 48 hours post infection. Infectious titer was improved when the virus was adapted to the Vero cell culture by serial passages. The titers were 6.50E+05 pfu/mL at P4 and 2.70E+07 pfu/mL at P11, respectively. Mutations at E484D, H655Y in SARS-CoV-2 S protein, E213K in VSV-M and V411M in VSV-L were identified in the higher passage P11.

FIGS. 17A-B show post-vaccination SARS-CoV-2 pseudoneutralization titers (PRNT) assay from Study HAM-CoV-2-001 Part A. The immunogenicity of rVSVΔG-SARS-CoV-2 clone MB1 and its ability to protect against SARS-CoV-2 challenge was studied in Golden Syrian hamster model of SARS-CoV-2 infection. Hamsters were administered rVSVΔG-SARS-CoV-2 clone MB1 via intramuscular (IM) or oral mucosal (OM) routes, or received a vaccine consisting of the SARS-CoV-2 S protein adjuvanted with aluminum phosphate (AdjuPhos) as described in Tables 10 and 11. In FIG. 17A, serum samples were collected on Days 7, 17, and 26 post-immunization and analyzed for SARS-CoV-2-specific PRNT titers. rVSVΔG-SARS-CoV-2 clone MB1 initiated immunogenicity after IM administration similarly to vaccination with S protein as shown by Day 7 and Day 26 post-vaccination SARS-CoV-2 neutralization assay titers. rVSVΔG-SARS-CoV-2 clone MB1 did not demonstrate SARS-CoV-2 neutralizing titers after OM administration at Day 7 or Day 26 post-vaccination. These titers were similar to titers in unvaccinated animals, with the exception of one animal with a high titer on Day 26. The dotted line indicates the limit of detection. FIG. 17B shows day 14 PRNT neutralizing titers from assay conducted with SARS-CoV-2. Serum samples were collected on Day 14 post-immunization and analyzed for SARS-CoV-2-specific PRNT titers. rVSVΔG-SARS-CoV-2 clone MB1 initiated immunogenicity after IM administration similarly to vaccination with S protein as shown by Day 14 post-vaccination SARS-CoV-2 neutralization assay titers, as determined by BIOQUAL. rVSVΔG-SARS-CoV-2 clone MB1 did not demonstrate SARS-CoV-2 neutralizing titers after OM administration at Day 14 post-vaccination, with titers similar to non-vaccinated animals. The dotted line indicates the limit of detection.

FIGS. 19A-C show that rVSVΔG-SARS-CoV-2 clones MB1 and MB2 protect against COVID-19 body weight loss in the Golden Syrian hamster model of SARS-CoV-2 infection (Study Part A). The immunogenicity of rVSVΔG-SARS-CoV-2 clones MB1 and MB2 and its ability to protect against SARS-CoV-2 challenge was studied in Golden Syrian hamster model of SARS-CoV-2 infection. Hamsters were administered rVSVΔG-SARS-CoV-2 clone MB1 or MB2 via intramuscular (IM) or oral mucosal (OM) routes, or received a vaccine consisting of the SARS-CoV-2 S protein adjuvanted with aluminum phosphate (Spike Protein/AdjuPhos) as described in Tables 10 and 11. We evaluated the ability of rVSVΔG-SARS-CoV-2 clones MB1 and MB2 to protect against SARS-CoV-2-induced body weight loss. FIG. 19A shows body weight change over the course of 14 days due to MB1 administration via IM or OM administration. FIGS. 19B-C show body weight change over the course of 5 days and 14 days, respectively, due to rVSVΔG-SARS-CoV-2 clone MB1 or 2 MB2 via IM or OM administration. Both rVSVΔG-SARS-CoV-2 clones MB1 and MB2 protected animals against SARS-CoV-2-induced body weight loss after IM administration similarly to protection by vaccination with adjuvanted SARS-CoV-2 S protein (Spike Protein/AdjuPhos) in the Golden Syrian hamster model. Both rVSVΔG-SARS-CoV-2 clones MB1 and MB2 did not protect animals from SARS-CoV-2-induced body weight loss, similarly to unvaccinated animals.

FIG. 20 shows a sequence alignment comparing the nucleotide sequence of the S gene in rVSVΔG-SARS-CoV-2 clone MB1 (SEQ ID NO: 150; the subject sequence (shown as "sbjct") in the alignment) with the codon-optimized, wild-type S gene in VSVΔG-SARS-CoV-2 (SEQ ID NO: 159; the query sequence (shown as "query") in the alignment).

FIGS. 21A-G show amino acid and nucleotide sequences for VSVΔG-SARS-CoV-2 clone MB2. FIG. 21A shows the order of genes in the genome of VSVΔG-SARS-CoV-2 clone MB2 from 5' to 3': VSV-N, VSV-P, VSV-M, codon-optimized SARS-CoV-2 S gene with H655Y and G1251* mutations, and VSV-L. Also shown are the XhoI and NheI sites. FIG. 21B shows the amino acid sequence for VSV-N (SEQ ID NO: 155). FIG. 21C shows the amino acid sequence for VSV-P (SEQ ID NO: 156). FIG. 21D shows the amino acid sequence for VSV-M (SEQ ID NO: 157). FIG. 21E shows the amino acid sequence for SARS-CoV-2 S protein with H665Y and G1251* mutations (SEQ ID NO: 158). The mutations are underlined. FIG. 21F shows the amino acid sequence for VSV-L with an 113431 silent mutation (SEQ ID NO: 152). The mutation is underlined. FIG. 21G shows the nucleotide sequence for the genome of VSVΔG-SARS-CoV-2 clone MB2, which has the nucleic acid sequence set forth in SEQ ID NO: 154. VSVΔG-SARS-CoV-2 clone MB2 encodes the proteins represented by the amino acid sequences in FIGS. 21B-F. The coding regions for VSV-N(nucleotides 64-1332), VSV-P (nucleotides 1396-2193), VSV-M (nucleotides 2250-2939), SARS-CoV-2 S protein (nucleotides 3102-6854; nucleotides that code for the H665Y and G1251* mutations are shown with black highlights and white text), and VSV-L (nucleotides 7011-13341; nucleotides that code for the 113431 silent mutation are shown with black highlights and white text) are underlined.

FIGS. 22A-F show amino acid and nucleotide sequences for Vector A, which is a VSV vector without the VSV-G gene. FIG. 22A shows the order of genes in Vector A from 5' to 3': VSV-N, VSV-P, VSV-M, and VSV-L. Also shown are the XhoI and NheI sites. FIG. 22B shows the amino acid sequence for Vector A VSV-N(SEQ ID NO: 155). FIG. 22C shows the amino acid sequence for Vector A VSV-P (SEQ ID NO: 156). FIG. 22D shows the amino acid sequence for Vector A VSV-M (SEQ ID NO: 157). FIG. 22E shows the amino acid sequence for Vector A VSV-L (SEQ ID NO: 152). FIG. 22F shows the nucleotide sequence for the genome of Vector A (without VSV-G gene) (SEQ ID NO: 160). The coding regions for VSV-N(nucleotides 64-1332), VSV-P (nucleotides 1396-2193), VSV-M (nucleotides 2250-2939), and VSV-L (nucleotides 3178-9507) are underlined. Vector A encodes the proteins represented by the amino acid sequences in FIGS. 22B-E.

FIGS. 23A-F show amino acid and nucleotide sequences for Vector B, which is a VSV vector without the VSV-G gene. FIG. 23A shows the order of genes in Vector B from 5' to 3': VSV-N, VSV-P, VSV-M, and VSV-L. Also shown are the BstBI and PacI sites. FIG. 23B shows the amino acid sequence for Vector B VSV-N(SEQ ID NO: 155). FIG. 23C shows the amino acid sequence for Vector B VSV-P (SEQ ID NO: 156). FIG. 23D shows the amino acid sequence for Vector B VSV-M (SEQ ID NO: 157). FIG. 23E shows the amino acid sequence for Vector B VSV-L (SEQ ID NO: 152). FIG. 23F shows the nucleotide sequence for the genome of Vector B (without VSV-G gene) (SEQ ID NO: 161). The coding regions for VSV-N(nucleotides 64-1332), VSV-P (nucleotides 1396-2193), VSV-M (nucleotides 2253-2942), and VSV-L (nucleotides 3062-9391) are underlined. Vector B encodes the proteins represented by the amino acid sequences in FIGS. 23B-E.

FIGS. 24A-G show amino acid and nucleotide sequences for VSVΔG-SARS-CoV-2 clone MB1. FIG. 24A shows the order of genes in VSVΔG-SARS-CoV-2 clone MB1 from 5' to 3': VSV-N(nucleotides 64 to 1332), VSV-P (nucleotides 1396 to 2193), VSV-M (nucleotides 2250 to 2939), codon-optimized SARS-CoV-2 S protein-optimized gene (nucleotides 3102 to 6854), and VSV-L (nucleotides 7012 to 13341). FIG. 24B shows the amino acid sequence for VSV-N(SEQ ID NO: 155). FIG. 24C shows the amino acid sequence for VSV-P (SEQ ID NO: 156). FIG. 24D shows the amino acid sequence for VSV-M (SEQ ID NO: 151) which comprises an amino acid Y61S mutation. FIG. 24E shows the amino acid sequence of SARS-CoV-2 S protein (SEQ ID NO: 153) which comprises R683G, S813F, and G1251* mutations. The G1251* mutation results in early termination of the SARS-CoV-2 S protein with the deletion of the last 23 amino acids. FIG. 24F shows the amino acid sequence for VSV-L (SEQ ID NO: 152). FIG. 24G shows the nucleotide sequence for VSVΔG-SARS-CoV-2 clone MB1 (SEQ ID NO: 150). VSVΔG-SARS-CoV-2 clone MB1 encodes the proteins represented by the amino acid sequences in FIGS. 24B-F (SEQ ID NOS: 155, 156, 151, 153, and 152, respectively). The following nucleotide and amino changes were observed relative to the wild-type sequence and are shown with black highlights and white text: (a) VSV-M—nucleotide Δ2431C; amino acid Y61S; (b) non-coding sequence—nucleotide C3058T; (c) SARS-CoV-2 S protein—nucleotide Δ5148G; amino acid R683G; (d) SARS-CoV-2 S protein—nucleotide C5539T; amino acid S813F; (e) SARS-CoV-2 S protein—nucleotide G6852T; amino acid G1251* (which results in early termination of the SARS-CoV-2 S protein with the deletion of the last 23 amino acids).

FIG. 25 shows NT50 (inverse of the dilution of the serum at which 50% of input virus is prevented from infecting cells) and VC average plaque counts for PRNT assays of clone isolates. VC=virus control.

FIG. 26A shows data for clones isolated in serum-containing medium. FIG. 26B shows data for clones isolated in serum-free medium. Anti-VSV-N antibody staining is shown in the y-axis. Anti-SARS-CoV-2 S protein neutralizing antibody staining (nAB) is shown in the x-axis.

FIG. 27 shows binding of recombinant virus of clones SC1, SC3, SC7, and MB2 to anti-hACE2 Ig antibody. Anti-VSV-N antibody staining is shown in the y-axis. Anti-huACE2 Ig antibody staining is shown in the x-axis.

FIG. 29A shows IM titration lung titers. FIG. 29B shows IM titration nose titers. FIG. 29C shows oral dosing lung titers. FIG. 29D shows oral dosing nose titers. IM, intramuscular; OM, oral mucosal; OM×2, two oral mucosal doses; PO, oral; IN+OM, intranasal+oral mucosal.

DETAILED DESCRIPTION

Figure 3:
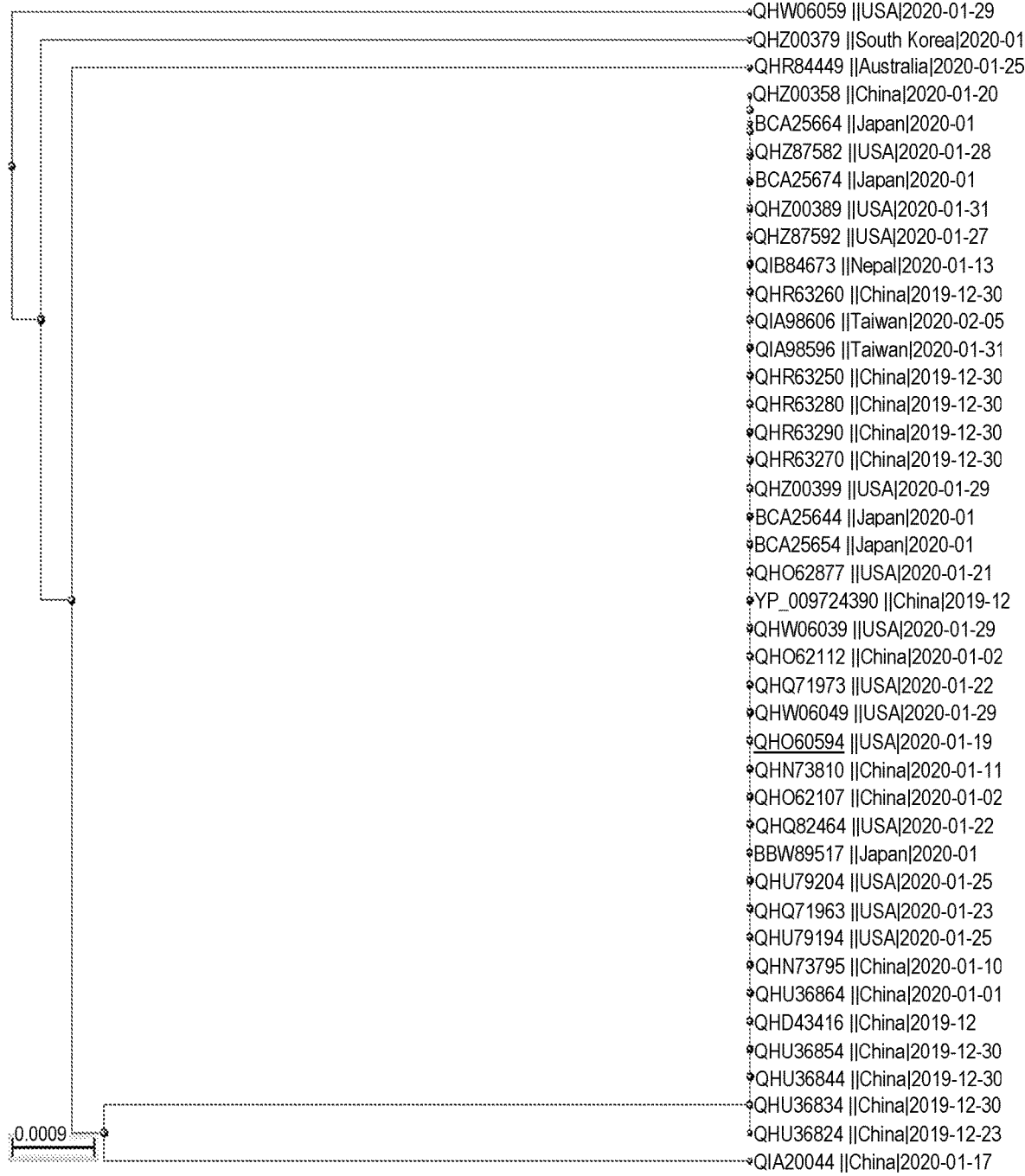
FIG. 3 is a phylogenic tree showing the country of origin for each corresponding SARS-CoV-2 in the alignment in FIG. 2. QHO60594 is the source sequence for SARS-CoV-2 S protein and is identified with an underline.

The present disclosure relates to vaccine compositions and uses thereof for preventing COVID-19 caused by the pandemic coronavirus Severe Acute Respiratory Syndrome coronavirus 2 (SARS-CoV-2). The present disclosure describes vaccine compositions for delivering a SARS-CoV-2 spike (S) protein or its immunogenic variant using replication-competent vesicular stomatitis virus (VSV) chimeric virus technology (VSVΔG). This technology allows immunization with the SARS-CoV-2 S protein or its immunogenic variant presented on the surface of infected cells and recombinant VSV particles in the context of immune stimulation by a viral infection. Different VSVΔG chimeras expressing the SARS-CoV-2 S protein or its immunogenic variant may be generated using different recombinant VSV backbones, for example, the one used to generate the FDA and EMA-licensed Merck Zaire Ebola virus (ZEBOV) vaccine (ERVEBO®). VSV (Indiana serotype) genetic backgrounds can be used but also other vesiculoviruses can be considered for use such as VSV (New Jersey serotype) or related vesiculoviruses such as Maraba virus, Carajas virus, Alagoas virus, Cocal virus, or Isfahan virus. Additionally, genetically modified variants of VSV (Indiana serotype) or the other vesculovirsues can be used. Moreover, the present disclosure describes adaptive mutants of the recombinant replicable VSV particle having better growth in a cell culture. These mutants have one or more mutations in, for example, the exposed loop (a solvent-exposed loop that comprises the S1/S2 cleavage site), S1/S2 cleavage site, S2' (previously referenced as S") cleavage site and/or cytoplasmic tail of the SARS-CoV-2 S protein. The vaccine compositions may be administered to subjects in one or two doses to induce protective immunity within days, for example, as little as 10 days. Vaccination up to 1-3 days after exposure to SARS-CoV-2 may be effective for preventing COVID-19. Upon vaccination of subjects, virus-neutralizing antibodies (nAbs) against the SARS-CoV-2 S protein may be induced in the subjects and harvested to make a pharmaceutical composition for preventing or treating COVID-19.

VSV typically grows very rapidly and robustly in cell culture. Generation of a chimeric virus by replacing VSV glycoprotein (VSV-G) with a heterologous glycoprotein like the SARS-CoV-2 S protein can substantially diminish the replicative capacity of the recombinant virus. In addition to using rational design of SARS-CoV-2 S protein variants to achieve VSVΔG-SARS-CoV-2 chimera for replication needed to support vaccine manufacturing as well as effective immunization (FIG. 4), the present disclosure describes that the evolutionary potential of VSV can also be used to identify novel SARS-CoV-2 S protein modifications that enhance virus growth.

Viruses like VSV with RNA genomes are known to have the capacity to mutate and evolve when faced with new circumstances that are not optimal virus growth (Novella I S. 2003. Contributions of vesicular stomatitis virus to the understanding of RNA virus evolution. Curr Opin Microbiol 6:399-405). These circumstances can be environmental factors like changes in temperature or alternative host cells, or they can be caused by deleterious modifications to the virus, such as replacement of the VSV-G with the glycoprotein from a heterologous virus. As VSV replicates under conditions in which replication is impaired, it will evolve mutations that contribute to restoration of its replicative capacity. Thus, this ability of VSV to generate favorable adaptive mutations can be used to identify amino acid substitutions or other types of modifications in the SARS-CoV-2 spike that enable improved replication of a VSVΔG-SARS-CoV-2 chimera. In the laboratory, evolution of favorable mutations can be accomplished by serial passage of the virus in cultured cells while monitoring for emergence of mutant strains that grows more robustly. Adaptive mutations responsible for improved growth can then be identified by determining the nucleotide sequence of the new virus strain.

I. Definitions

The term "antibody" includes intact molecules as well as any fragments thereof that are capable of specifically binding the epitope of the antibody, such as, but not limited to, Fab, $F(ab')_2$, Fv and scFv which are capable of binding the epitope determinant. These antibody fragments retain some ability to selectively bind with its antigen or receptor and include, for example: (i) Fab, the fragment which contains a monovalent antigen-binding fragment of an antibody molecule can be produced by digestion of whole antibody with the enzyme papain to yield an intact light chain and a portion of one heavy chain; (ii) Fab', the fragment of an antibody molecule can be obtained by treating whole antibody with pepsin, followed by reduction, to yield an intact light chain and a portion of the 20 heavy chain; two Fab' fragments are obtained per antibody molecule; (iii) $F(ab')_2$, the fragment of the antibody that can be obtained by treating whole antibody with the enzyme pepsin without subsequent reduction; $F(ab')_2$ is a dimer of two Fab' fragments held together by two disulfide bonds; (iv) scFv, including a genetically engineered fragment containing the variable region of a heavy and a light chain as a fused single chain molecule.

As used herein, the terms "antigen" or "immunogen" are used interchangeably to refer to a substance, typically a protein, which is capable of inducing an immune response in a subject. The term also refers to proteins that are immunologically active in the sense that once administered to a subject (either directly or by administering to the subject a nucleotide sequence or vector that encodes the protein) is able to evoke an immune response of the humoral and/or cellular type directed against that protein.

The term "derived from" used herein refers to an origin or source, and may include naturally occurring, recombinant, unpurified or purified molecules. The molecules of the present disclosure may be derived from viral or non-viral molecules. A protein or polypeptide derived from an original protein or polypeptide may comprise the original protein or polypeptide, in part or in whole, and may be a fragment or variant of the original protein or polypeptide. A nucleic acid molecule or polynucleotide derived from an original nucleic acid molecule or polynucleotide may comprise the original nucleic acid molecule or polynucleotide, in part or in whole, and may be a fragment or variant of the original nucleic acid molecule or polynucleotide.

The term "foreign gene" used herein refers to a gene of an origin or source different from that of a vector, into which the foreign gene is inserted. For example, the vector may be derived from a vesicular stomatitis virus (VSV) while the foreign gene may be derived from a Severe Acute Respiratory Syndrome coronavirus 2 (SARS-CoV-2).

The term "fragment" of a protein as used herein refers to a polypeptide having an amino acid sequence that is the same as a part, but not all, of the amino acid sequence of the protein. A fragment may be a functional fragment of a protein that retains the same function as the protein.

The terms "nucleic acid molecule" and "polynucleotide" are used interchangeably herein to refer to a polymer of nucleic acids of any length and having a "nucleic acid sequence" or "nucleotide sequence." As used herein the terms "nucleotide sequence" and "nucleic acid sequence" refer to a deoxyribonucleic acid (DNA) sequence, a ribonucleic acid (RNA) sequence or a combination thereof, including, without limitation, messenger RNA (mRNA), DNA/RNA hybrids, or synthetic nucleic acids. The "nucleic acid molecule" and "polynucleotide" can be single-stranded, or partially or completely double-stranded (duplex), which can be homoduplex or heteroduplex.

For the proteins of the present disclosure to be expressed, the protein coding sequence should be "operably linked" to regulatory or nucleic acid control sequences that direct transcription and translation of the protein. As used herein, a coding sequence and a nucleic acid control sequence or promoter are said to be "operably linked" when they are covalently linked in such a way as to place the expression or transcription and/or translation of the coding sequence under the influence or control of the nucleic acid control sequence. The "nucleic acid control sequence" can be any nucleic acid element, such as, but not limited to promoters, enhancers, IRES, introns, and other elements described herein that direct the expression of a nucleic acid sequence or coding sequence that is operably linked thereto. The expression of the transgenes of the present disclosure can be under the control of a constitutive promoter or of an inducible promoter, which initiates transcription when exposed to some particular external stimulus, such as, without limitation, antibiotics such as tetracycline, hormones such as ecdysone, or heavy metals. The promoter can also be specific to a particular cell-type, tissue or organ. Many suitable promoters and enhancers are known in the art, and any such suitable promoter or enhancer may be used for expression of the transgenes of the disclosure. For example, suitable promoters and/or enhancers can be selected from the Eukaryotic Promoter Database (EPDB).

The term "percent homology" refers to the amount of sequence identity between two sequences. If a variant is a fragment of the wild-type SARS-CoV-2 S protein, % homology is measured over the length of the fragment instead of the length of the wild-type SARS-CoV-2 S protein. In some embodiments, the full-length variant or fragment variant comprises at least 90%, 91%, 92%, 93%, 94%, 95%, 96%, 97%, 98%, or 99% homology with the wild-type SARS-CoV-2 S protein. In some embodiments, the full-length variant or fragment variant comprises 100% homology with the wild-type SARS-CoV-2 S protein (SEQ ID NO: 1).

The terms "protein", "peptide", "polypeptide", and "amino acid sequence" are used interchangeably herein to refer to polymers of amino acid residues of any length. The polymer may be linear or branched, it may comprise modified amino acids or amino acid analogs, and it may be interrupted by chemical moieties other than amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling or bioactive component.

As used herein the term "transgene" may be used to refer to "recombinant" nucleotide sequences that may be derived from any of the nucleotide sequences encoding the proteins of the present disclosure. The term "recombinant" means a nucleotide sequence that has been manipulated "by man" and which does not occur in nature, or is linked to another nucleotide sequence or found in a different arrangement in nature. It is understood that manipulated "by man" means manipulated by some artificial means, including by use of machines, codon optimization, restriction enzymes, etc.

For example, in one embodiment the nucleotide sequences may be mutated such that the activity of the encoded proteins in vivo is abrogated.

As regards codon optimization, the nucleic acid molecules of the disclosure have a nucleotide sequence that encodes the antigens of the disclosure and can be designed to employ codons that are used in the genes of the subject in which the antigen is to be produced. Many viruses, including coronaviruses, use a large number of rare codons and, by altering these codons to correspond to codons commonly used in the desired subject, enhanced expression of the antigens can be achieved. In some embodiments, the codons used are "humanized" codons, i.e., the codons are those that appear frequently in highly expressed human genes (Andre et al., J. Virol. 72:1497-1503, 1998) instead of those codons that are frequently used by a coronavirus. Such codon usage provides for efficient expression of the transgenic coronavirus proteins in human cells. Any suitable method of codon optimization may be used. Such methods, and the selection of such methods, are well known to those of skill in the art. In addition, there are several companies that will optimize codons of sequences, such as Geneart (geneart.com). Thus, the nucleotide sequences of the disclosure can readily be codon optimized.

The disclosure further provides nucleotide sequences encoding functionally and/or antigenically equivalent variants and derivatives of the antigens of the disclosure and functionally equivalent fragments thereof, for example, the SARS-CoV-2 S protein or an immunogenic variant thereof. These functionally equivalent variants, derivatives, and fragments display the ability to retain antigenic activity. For instance, changes in a DNA sequence that do not change the encoded amino acid sequence, as well as those that result in conservative substitutions of amino acid residues, one or more than one amino acid deletions or additions, and substitution of amino acid residues by amino acid analogs are those which will not significantly affect properties of the encoded polypeptide. In one embodiment, the variants have at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98% or at least 99% homology or identity to the antigen, epitope, immunogen, peptide or polypeptide of interest.

For the purposes of the present disclosure, sequence identity or homology is determined by comparing the sequences when aligned so as to maximize overlap and identity while minimizing sequence gaps. In particular, sequence identity may be determined using any of a number of mathematical algorithms. A nonlimiting example of a mathematical algorithm used for comparison of two sequences is the algorithm of Karlin & Altschul, Proc. Natl. Acad. Sci. USA 1990; 87: 2264-2268, modified as in Karlin & Altschul, Proc. Natl. Acad. Sci. USA 1993; 90: 5873-5877.

Another example of a mathematical algorithm used for comparison of sequences is the algorithm of Myers & Miller, CABIOS 1988; 4: 11-17. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson & Lipman, Proc. Natl. Acad. Sci. USA 1988; 85: 2444-2448.

Advantageous for use according to the present disclosure is the WU-BLAST (Washington University BLAST) version 2.0 software. WU-BLAST version 2.0 executable programs for several UNIX platforms can be downloaded. This program is based on WU-BLAST version 1.4, which in turn is based on the public domain NCBI-BLAST version 1.4 (Altschul & Gish, 1996, Local alignment statistics, Doolittle ed., Methods in Enzymology 266: 460-480; Altschul et al., Journal of Molecular Biology 1990; 215: 403-410; Gish & States, 1993; Nature Genetics 3: 266-272; Karlin & Altschul, 1993; Proc. Natl. Acad. Sci. USA 90: 5873-5877; all of which are incorporated by reference herein).

The various recombinant nucleotide sequences and proteins of the disclosure are made using standard recombinant DNA and cloning techniques. Such techniques are well known to those of skill in the art. See for example, "Molecular Cloning: A Laboratory Manual", second edition (Sambrook et al. 1989).

The term "variant" of a protein refers to a polypeptide having an amino acid sequence that is the same as that of the protein except having at least one amino acid modified, for example, deleted, inserted, or replaced, so long as the variant functions like the protein (even if the amount or characteristics of the function differ from the protein). The amino acid replacement may be a conservative amino acid substitution. The amino acid replacement may be a non-essential amino acid residue in the protein. A "conservative amino acid substitution" is one in which the amino acid residue is replaced with an amino acid residue having a similar side chain. Families of amino acid residues having similar side chains are known in the art. For example, amino acids are generally divided into four families:
  (1) acidic—aspartatic acid and glutamic acid;
  (2) basic—lysine, arginine, histidine;
  (3) non-polar—alanine, valine, leucine, isoleucine, proline, phenylalanine, methionine, tryptophan (with valine, isoleucine, and leucine seen as particularly related); and
  (4) uncharged polar—glycine, asparagine, glutamine, cysteine, serine threonine, tyrosine (with asparagine and glutamine seen as particularly related).
Conservative amino acid substitutions may be made within these families.

Phenylalanine, tryptophan, and tyrosine are sometimes classified as aromatic amino acids with hydrophobic side chains and may be substituted for each other. Glycine may also be substituted for alanine and vice versa. Serine, threonine, and methionine may also be substituted for each other.

For example, it is reasonably predictable that an isolated replacement of leucine with isoleucine or valine, or vice versa; an aspartate with a glutamate or vice versa; a threonine with a serine or vice versa; or a similar conservative replacement of an amino acid with a structurally related amino acid, will not have a major effect on the biological activity. Proteins having substantially the same amino acid sequence as the sequences illustrated and described but possessing minor amino acid substitutions that do not substantially affect the immunogenicity of the protein are, therefore, within the scope of the disclosure. Other immunogenic variants are also encompassed by this disclosure.

The terms "virus" and "viral particle" are used herein interchangeably and refer to a replicable virus having its genome enclosed by a protein coat. The term "replication capacity" used herein refers to how quickly a virus or viral particle reproduces (i.e., replicates). Where the virus or viral particle is recombinant and carries a foreign gene and/or foreign protein, the replication capacity of the virus or viral particle may be reduced.

II. Vectors and Viral Particles

A recombinant VSV vector or recombinant VSV viral particle comprises at least a portion of the VSV genome comprising the N, P, M, and L genes and a nucleic acid sequence encoding the SARS-CoV-2 S protein or an immunogenic variant thereof. This allows generation of a recombinant VSV particle comprising this vector and displaying the S protein or an immunogenic variant thereof on the surface of the VSV particle, specifically the S protein or immunogenic variant thereof displayed on the surface of the VSV particle is the S protein encoded by the vector or by the nucleic acids of the recombinant VSV particle.

In certain embodiments the VSV particle is replicable.

In some embodiments the vectors or particles encode an immunogenic recombinant protein comprising a SARS-CoV-2 S protein or an immunogenic variant thereof. In some embodiments, the vectors or particles encode an immunogenic recombinant protein encoding both a SARS-CoV-2 S protein or an immunogenic variant thereof and at least a fragment of the VSV glycoprotein (G).

These vectors or particles, or the immunogenic proteins encoded by them, may be used as vaccines.

Any vector that allows expression of the proteins of the present disclosure, namely, the SARS-CoV-2 S protein or an immunogenic variant thereof, may be used in accordance with the present disclosure. The vectors may contain a suitable gene regulatory region, such as a promoter or enhancer, such that the proteins and viral particles of the present disclosure can be produced.

When the aim, for example, is to express the proteins of the disclosure in vitro, or in cultured cells, or in any prokaryotic or eukaryotic system for the purpose of producing the protein(s), then any suitable vector can be used depending on the application. For example, plasmids, viral vectors, bacterial vectors, protozoal vectors, insect vectors, baculovirus expression vectors, yeast vectors, mammalian cell vectors, and the like, can be used. Suitable vectors can be selected by the skilled artisan taking into consideration the characteristics of the vector and the requirements for expressing the proteins under the identified circumstances.

In certain embodiments, the antigens and/or antibodies of the present disclosure may be used in vitro (such as using cell-free expression systems) and/or in cultured cells grown in vitro in order to produce the encoded SARS-CoV-2- antigens and/or antibodies which may then be used for various applications such as in the production of proteinaceous vaccines. For such applications, any vector that allows expression of the antigens and/or antibodies in vitro and/or in cultured cells may be used.

When the aim is to express the proteins or viral particles of the disclosure in vivo in a subject, for example, in order to generate an immune response against a SARS-CoV-2 antigen and/or generate protective immunity against SARS-CoV-2, expression vectors that are suitable for expression on that subject, and that are safe for use in vivo, should be chosen. Methods on generating an immune response against SARS-CoV-2 are described in detail in Section VII below.

For applications where it is desired that the proteins be expressed in vivo, for example, when the transgenes of the disclosure are used in DNA or DNA-containing vaccines, any vector that allows for the expression of the proteins of the present disclosure and is safe for use in vivo may be used. In some embodiments the vectors used are safe for use in humans, mammals and/or laboratory animals.

In some embodiments it may be desirable to express and isolate the proteins or viral particles of the present disclosure, such as from animal subjects or cells (such as bacterial cells, yeast, insect cells, and mammalian cells) grown in culture, for preclinical testing of the immunogenic recombinant proteins or vaccines of the disclosure. Any suitable transfection, transformation, or gene delivery methods can be used and such methods are well known by those skilled in the art. Examples of methods known in the art can be chosen from transfection, transformation, microinjection, infection, electroporation, lipofection, and liposome-mediated delivery. The proteins and viral particles of the disclosure can also be expressed using methods known in the art, including in vitro transcription/translation systems.

In other embodiments, it may be desirable to express the proteins or viral particles of the disclosure in human subjects, such as in clinical trials and for actual clinical use of the immunogenic recombinant proteins or vaccine of the present disclosure. In some embodiments, vectors used for these in vivo applications are attenuated to vector from amplifying in the subject. For example, if plasmid vectors are used, they may lack an origin of replication that functions in the subject so as to enhance safety for in vivo use in the subject. If viral vectors are used, they may be attenuated or replication-defective in the subject, again, so as to enhance safety for in vivo use in the subject.

In some embodiments of the present disclosure, viral vectors are used. The present disclosure relates to recombinant vesicular stomatitis (VSV) vectors, however, other vectors may be contemplated in other embodiments of the disclosure such as, but not limited to, prime boost administration which may comprise administration of a recombinant VSV vector in combination with another recombinant vector expressing one or more SARS-CoV-2 epitopes. Viral expression vectors are well known to those skilled in the art and include, for example, viruses such as adenoviruses, adeno-associated viruses (AAV), alphaviruses, herpesviruses, retroviruses and poxviruses, including avipox viruses, attenuated poxviruses, vaccinia viruses, and particularly, the modified vaccinia Ankara virus (MVA; ATCC Accession No. VR-1566). Such viruses, when used as expression vectors are innately non-pathogenic in the selected subjects such as humans or have been modified to render them non-pathogenic in the selected subjects. For example, replication-defective adenoviruses and alphaviruses are well known and can be used as gene delivery vectors.

The nucleotide sequences of the present disclosure may be inserted into "vectors." The term "vector" is widely used and understood by those of skill in the art, and as used herein the term "vector" is used consistent with its meaning to those of skill in the art. For example, the term "vector" is commonly used by those skilled in the art to refer to a vehicle that allows or facilitates the transfer of nucleic acid molecules from one environment to another or that allows or facilitates the manipulation of a nucleic acid molecule.

A. Recombinant VSV Vectors and Recombinant VSV Particles

In some embodiments, the vector is a recombinant vesicular stomatitis virus (VSV) vector. The term "VSV vector" refers to a vector of the Rhabdoviridae family of enveloped viruses that can be used to deliver genetic material to a host cell, and the VSV vector can be maintained by replication within the host cell. VSVs contain a single-stranded, non-segmented, negative-sense RNA genome. Because the VSV naturally infects livestock and is known to infect humans producing mild illness or no symptoms of infection, the VSV has been modified to be a human vaccine vector for producing recombinant replicable VSV particles presenting foreign immunogenic antigens to induce protective immune response to a pathogen in a subject. VSV vectors are practical, safe, and immunogenic vectors that are used for conducting animal studies, and an attractive candidate for developing vaccines for use in humans.

A VSV vector may comprise any combination of the VSV genes N, P, M, G, and L (VSV-N, VSV-P, VSV-M, VSV-G, and VSV-L), wherein some or all of these genes may be present or absent, and each of these genes may be present or absent in part or in its entirety. The VSV genes are described in Section II.C below. Additional protein coding genes or open reading frames (ORFs) may be expressed from a VSV vector.

A recombinant VSV vector may comprise a VSV genome, which may provide a recombinant VSV particle. A recombinant VSV particle may also comprise a VSV genome. In some embodiments, the recombinant VSV vector and/or recombinant VSV particle is replicable.

1. Modified VSV Genome

In many embodiments, the recombinant VSV vector or recombinant VSV particle may comprise a modified VSV genome wherein at least a portion of the VSV genome is present. In some embodiments, the recombinant VSV vector or recombinant VSV particle comprises the VSV-N, VSV-P, VSV-M, and VSV-L genes, or any combination thereof. The VSV-N, VSV-P, VSV-M, and VSV-L genes are described in Section II.C.1 below. In some embodiments, the VSV genome further comprises at least a fragment of the VSV-G gene. In other embodiments, the VSV genome may exclude the VSV-G gene in its entirety. The VSV-G is described in Section II.C.2 below.

2. Modified VSV Genome and a Foreign Gene

Figure 4:
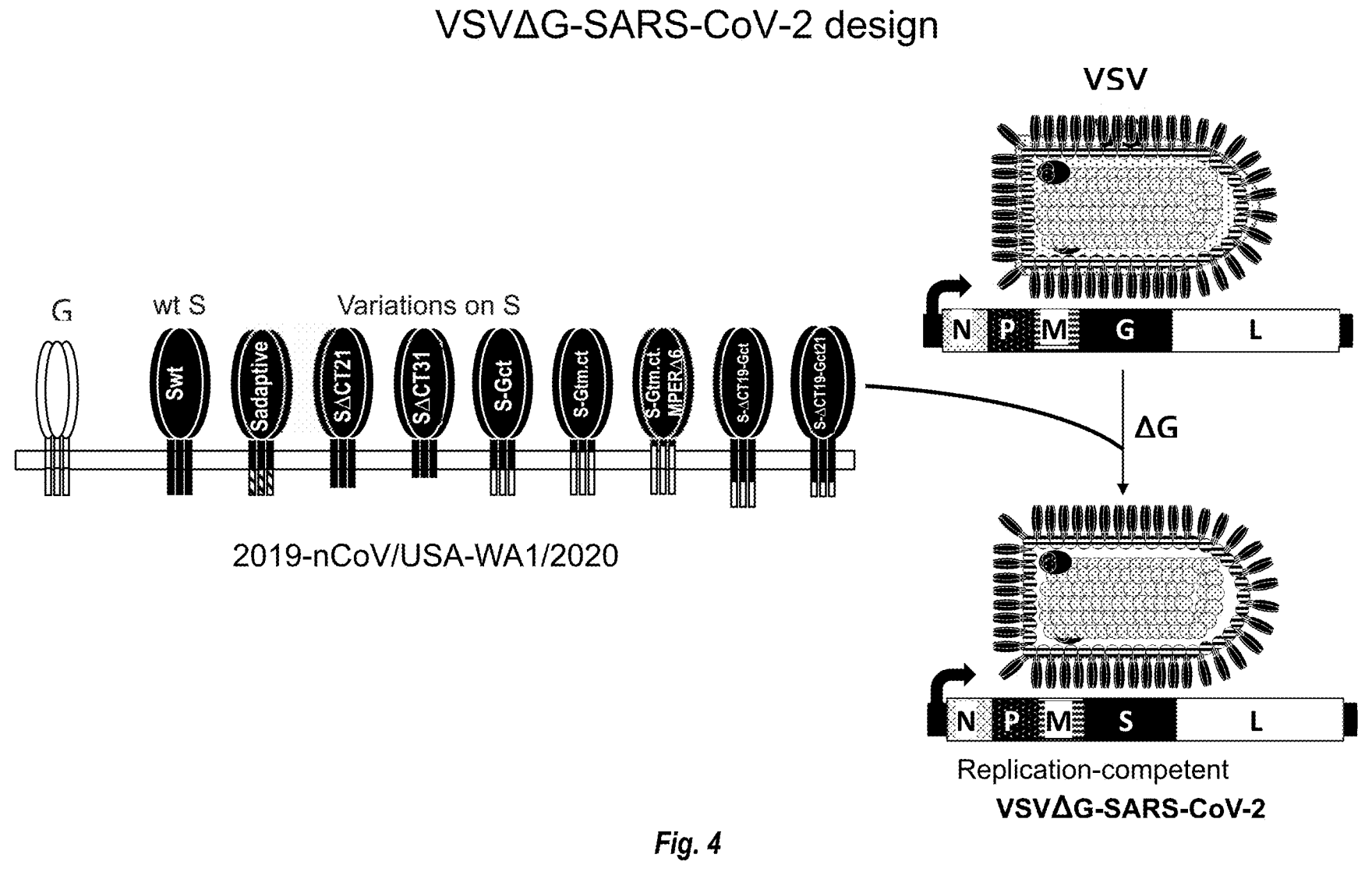

In some embodiments, the modified VSV genome may further comprise a foreign gene, thereby giving rise to expression of a foreign epitope. In some embodiments, the foreign gene is derived from SARS-CoV-2 and the foreign epitope is a SARS-CoV-2 epitope, for example, a SARS-CoV-2 S protein or an immunogenic variant thereof. Therefore, a recombinant VSV vector or recombinant VSV particle may comprise a modified VSV genome and a nucleic acid sequence encoding the SARS-CoV-2 S protein or an immunogenic variant thereof. FIGS. 4 and 5 show exemplary nucleotide sequences encoding VSVΔG-SARS-CoV-2 S proteins inserted in a VSV genomic background, encoding the SARS-CoV-2 S protein or variant thereof. As such, in some embodiments, a recombinant VSV vector or recombinant VSV particle may comprise modified VSV genome and a nucleotide sequence encoding a SARS-CoV-2 S protein. The SARS-CoV-2 S protein and variants thereof are described in Section II.B below, while immunogenic proteins are described below in Section III below. Exemplary recombinant VSV vectors comprising modified VSV genome and a SARS-CoV-2 S protein variant are described in Section II.F below. In some embodiments, the recombinant VSV particle displays the SARS-CoV-2 S protein or variant thereof on its surface.

B. SARS-CoV-2 S Proteins

A recombinant VSV vector, recombinant VSV particle, immunogenic recombinant protein, or SARS-CoV-2 vaccine may comprise any epitope recognized by an anti-SARS-CoV-2 antibody. For example, the SARS-CoV-2 S protein of any coronavirus that causes COVID-19, including any coronavirus that may be isolated from a COVID-19 patient, may be used. In many embodiments, a recombinant VSV vector, recombinant VSV particle, immunogenic recombinant protein, or SARS-CoV-2 vaccine of the present disclosure may comprise a SARS-CoV-2 S protein or variant thereof.

The SARS-CoV-2 S protein binds to and enters the host cell by recognizing the receptor ACE2. (Li, W. et al., Nature, 426, 46965 (2003): 450-454.) The SARS-CoV-2 S protein has 1273 amino acids and contains S1 and S2 subunits (amino acids 14-685 and 686-1273, respectively). (Huang, Y. et al., Acta Pharmacologica Sinica, 41,9 (2020):1141-1149.) The S1/S2 cleavage site lies (SPRRARSV, which are amino acids 680-687 in SEQ ID NO: 1, wherein cleavage occurs between R685 and S686) within a solvent-exposed loop Furin (Wrapp, D. et al., Science, 367,6483 (2020): 1260-1263; amino acids 673-691 in SEQ ID NO: 1) and is cleaved by proteases such as Furin that recognize basic amino acid sequences like 682-RRAR-685 found in the SARS-CoV-2 S precursor protein. Cleavage at S1/S2 enhances viral infectivity. (Tang et al., Coronavirus membrane fusion mechanism offers a potential target for antiviral development, Antiviral Res (2020), doi:10.1016/j.antiviral.2020.104792.) The S2' cleavage site (previously referenced as S"; SKPSKRSF, which are amino acids 810-817 in SEQ ID NO: 1, wherein cleavage occurs between 815R and 816S) lies within a solvent-exposed loop (Wrapp, D. et al., Science, 367,6483 (2020):1260-1263; amino acids 673-691 in SEQ ID NO: 1) and is joined to the N-terminus of the fusion peptide. Cleavage at the S2' site at amino acid R815 by proteases like Cathepsin L or TMPRSS2 triggers fusion peptide activity that allows the S2 subunit to direct fusion between the viral and cellular membranes. Cleavage at the S2' site is related to virus infection. (Tang et al., Coronavirus membrane fusion mechanism offers a potential target for antiviral development, Antiviral Res (2020), doi:10.1016/j.antiviral.2020.104792.)

All numbering of the SARS-CoV-2 S protein in the disclosure and claims is relative to SEQ ID NO: 1. This includes both position numbers and numbers of amino acids deleted from certain truncation mutations; all are relative to SEQ ID NO: 1. Unless otherwise specified by referring to a particular variant or by specifically referring to wildtype, all references in the disclosure and claims to SARS-CoV-2 S protein or S protein include both the wildtype and immunogenic variant forms of the S protein (including immunogenic variants that have substitution mutations, insertion mutations, deletion mutations (including fragments, which are shorter in length than wildtype), and/or modifications).

The SARS-CoV-2 S protein further comprises the following domains: signal peptide (amino acids 1-13 in Huang et al.; amino acids 1-15 in SEQ ID NO: 1), N-terminal domain (NTD; amino acids 14-305 in Huang et al.), receptor-binding domain (RBD; amino acids 319-541 in Huang et al.), fusion peptide (FP; amino acids 788-806 in Huang et al.), heptad repeat 1 (HR1; amino acids 912-984 in Huang et al.), heptad repeat 2 (HR2; amino acids 1163-1213 in Huang et al.), transmembrane domain (TMD; amino acids 1213-1237 in Huang et al.; amino acids 1218-1234 in SEQ ID NO: 1), and cytoplasmic tail (CT; amino acids 1237-1273 in Huang et al.; amino acids 1235-1273 in SEQ ID NO: 1) (Huang, Y. et al., Acta Pharmacologica Sinica, 41,9 (2020): 1141-1149). Within the HR2 domain, lies a membrane-proximal external region (MPER; amino acids 1205-1213 in Zhu et al.; amino acids 1206-1217 in SEQ ID NO: 1). (Zhu, W. et al., Journal of Virology, 94,14 (2020):1-12.) Within the CT lies an endoplasmic reticulum retention sequence (ERRS; amino acids 1251-1255 in Ujike et al.). (Ujike, M. et al., Journal of General Virology, 97,8 (2016):1853-1864.)

The SARS-CoV-2 virus binds to the host cell receptor ACE2 via the RBD in the S1 subunit. (Huang, Y. et al., Acta Pharmacologica Sinica, 41,9 (2020):1141-1149.) This binding promotes the formation of endosomes, which initiates viral fusion activity under low pH. The S2 subunit, which comprises the FP, HR1, HR2, TMD and CT, is responsible for viral fusion and entry. (Huang, Y. et al., Acta Pharmacologica Sinica, 41,9 (2020):1141-1149.) FP is a 15-20 stretch of mainly hydrophobic amino acids (such as glycine or alanine) and has been shown to disrupt and connect lipid bilayers of the host cell membrane. (Huang, Y. et al., Acta Pharmacologica Sinica, 41,9 (2020):1141-1149.) HR1 and HR2 comprise repeats of a heptapeptide, and the two HR domains come together to form a six-helical bundle that fuses the host cell membrane with the viral membrane. (Huang, Y. et al., Acta Pharmacologica Sinica, 41,9 (2020): 1141-1149.) Following entry, viral RNA is released into the cytoplasm and their replication and transcription begin. (Song, Z. et al., Viruses, 11,59 (2019):1-58.)

The SARS-CoV-2 virus assembles by packaging genomic RNA and nucleocapsid (N) protein from the cytoplasm, followed by budding into the lumen of the endoplasmic reticulum (ER)-Golgi intermediate compartment (ERGIC). (Song, Z. et al., Viruses, 11,59 (2019):1-58.) The ERRS is thought to facilitate accumulation of SARS-CoV-2 S proteins at the SARS-CoV-2 budding site and SARS-CoV-2 S protein incorporation into viral particles. (Ujike, M. et al., Journal of General Virology, 97,8 (2016):1853-1864.)

In many embodiments, any variant of the SARS-CoV-2 S protein may be used in the recombinant VSV vector, recombinant VSV particle, immunogenic recombinant protein, or SARS-CoV-2 vaccine of the present disclosure. In some embodiments, the variant may be of equal (i.e., full-length), shorter, or longer length when compared to the wild-type SARS-CoV-2 S protein. In some embodiments, the variant comprises truncations or fragments of the wild-type SARS-CoV-2 S protein. In some embodiments, the variant comprises point mutations, silent mutations, synonymous mutations, nonsynonymous mutations, nonsense mutations, deletions, and/or insertions. In some embodiments, the variant comprises at least one mutation and/or truncation relative to the wild-type SARS-CoV-2 S protein (SEQ ID NO: 1). In some embodiments, the SARS-CoV-2 S protein comprises an amino acid sequence having a length of at least 1223, 1228, 1233, 1238, 1243, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277 or 1278 amino acids and having homology over its own length of at least 90, 91, 92, 93, 94, 95, 96, 97, 98, or 99% homology to any one of SEQ ID NOS: 1, 4, 7, 10, 13, 16, 19, 22, 25-67, 153, or 158. In some embodiments, the SARS-CoV-2 S protein or immunogenic variant thereof (or the nucleotide sequence encoding it) comprises any one of SEQ ID NOS: 1, 4, 7, 10, 13, 16, 19, 22, 25-67, 153, or 158.

Advantageously, codons may be optimized for the SARS-CoV-2 S gene so it has the codon bias that is characteristic of VSV. This also results in a relatively low Guanine+Cytosine content of 40-45%. See, e.g., Rabinovich et al., PLoS One. 2014 Sep. 12; 9(9):e106597. doi: 10.1371/journal.pone.0106597. eCollection 2014. Adaptive mutations may also be used to identify variants of the SARS-CoV-2 S protein gene capable of improving replication capacity of a recombinant VSV comprising the SARS-CoV-2 S gene.

The nucleotide sequence encoding a SARS-CoV-2 S protein may comprise any of the nucleotide sequences of SEQ ID NOS: 2, 3, 5, 6, 8, 9, 11, 12, 14, 15, 17, 18, 20, 21, 23, and 24, as shown in FIG. 1B, 1C, 1E, 1F, 1H, 1I, 1K, 1L, 1N, 1O, IQ, 1R, 1T, 1U, 1W or 1X; any nucleotide sequence encoding a SARS-CoV-2 S protein chosen from SARS-CoV-2 genome sequences that are readily available to a skilled artisan at Genbank, including but not limited to LR757997, MT072688, MN996527, MT039873, MN938384, MT020781, MN996529, MN996530, MN996531, MT044258, LR757998, LR757996, MT066175, MT066176, LR757995, LC522972, LC522973, LC522974, LC522975, MT039887, MN988668, MN988669, MT044257, MT039888, MN997409, MN985325, MN994467, MT027062, MT027063, MT027064, MT020880, MT020881, MN988713, MT019533, MN994468, MT093571, MT019530, MT019532, MN975262, MN996528, MT007544, MT019529, MT019531, MT049951, MT039890, MN908947, NC_045512, MT093631; or any of the amino acid sequences of SEQ ID NOS: 1, 4, 7, 10, 13, 16, 19, 22, 25-67, 153, or 158. The SARS-CoV-2 S protein may comprise any of the amino acid sequences of SEQ ID NOS: 1, 4, 7, 10, 13, 16, 19, 22, 25-67, 153, or 158. The SARS-CoV-2 S protein may comprise any amino acid sequence encoded by all or part of the nucleic acid sequences referenced herein.

In many embodiments, the SARS-CoV-2 S protein may have an amino acid sequence of at least 70%, 80%, 90%, 95%, 99%, or 100% identical to the amino acid sequence of any of the specific SARS-CoV-2 S proteins referenced herein. In many embodiments, the SARS-CoV-2 S protein of the present disclosure may comprise a nucleotide sequence that is a fragment of the wild-type SARS-CoV-2 S protein nucleotide sequence or a nucleotide sequence of a SARS-CoV-2 S protein nucleotide sequence having at least one modification (e.g., deletion, addition, substitution). The SARS-CoV-2 S protein may comprise at least one mutation relative to SEQ ID NO: 1.

In many embodiments, the SARS-CoV-2 S protein is an immunogenic variant that is capable of inducing an immune response in a subject administered the immunogenic variant. General descriptions on immunogenic recombinant proteins as well as details that relate to immunogenic SARS-CoV-2 S protein variants are described in Section III below.

1. Optional Deletions to the SARS-CoV-2 S Protein

A variety of C-terminal deletions have been observed in variants of the SARS-CoV-2 S protein (see Example 8 below), which may provide a benefit by improving viral stability. In many embodiments, the SARS-CoV-2 S protein comprises a C-terminal deletion. The SARS-CoV-2 S protein may be a fragment of the wild-type SARS-CoV-2 S protein. SARS-CoV-2 S proteins with optional deletion(s) are provided herein. In some embodiments, the SARS-CoV-2 S protein is the same length as or is a fragment of the full-length of the SARS-CoV-2 S protein. In some embodiments, the deleted SARS-CoV-2 S protein is an immunogenic recombinant protein.

In some embodiments, distinct domains or subunits of the SARS-CoV-2 S protein are removed to produce the immunogenic variant. Distinct domains or subunits that are removed from the SARS-CoV-2 S protein may be chosen from S1 subunit, S2 subunit, S1/S2 cleavage site, protease cleavage site, signal peptide, NTD, RBD, FP, HR1, HR2, and CT.

In some embodiments, deletions of the SARS-CoV-2 S protein are made starting from the C-terminus of SEQ ID NO: 1 or any of the other variants of the S protein described herein. The full-length SARS-CoV-2 S protein comprises 1273 amino acids. A fragment length of SARS-CoV-2 S protein is calculated by subtracting the number of deleted amino acids from 1273. In some embodiments, the SARS-CoV-2 S protein is 1223, 1228, 1233, 1238, 1243, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277 or 1278 amino acids. In some embodiments, the SARS-CoV-2 S protein may comprise a fragment of the SARS-CoV-2 S protein having a deletion at the C-terminal end of the SARS-CoV-2 S protein. In some embodiments, the SARS-CoV-2 S protein comprises a deletion of 1, 2, 3, 4, 5, 6, 7, 8, 9, 10, 11, 12, 13, 14, 15, 16, 17, 18, 19, 20, 21, 22, 23, 24, 25, 30, 35, 40, 45, or 50 amino acids from the C-terminal end of an S protein described herein with the deletion measured relative to the length of SEQ ID NO: 1.

In some embodiments, the SARS-CoV-2 S protein may have a deletion of from 1 to 30, 5 to 25, or 9 to 23 amino acids from the C-terminal end of the SARS-CoV-2 S protein. The SARS-CoV-2 S protein may comprise a fragment of the SARS-CoV-2 S protein having a deletion of 9 amino acids (Δ9), 13 amino acids (Δ13), 19 amino acids (Δ19), 21 amino acids (Δ21), or 23 amino acids (Δ23) at the C-terminal end of the SARS-CoV-2 S protein. In some embodiments, the SARS-CoV-2 S protein comprises a deletion of 1 to 30, 5 to 25, or 9 to 23 amino acids from the C-terminal end of SEQ ID NO: 1. In some embodiments, the SARS-CoV-2 S protein comprises a deletion of 9 amino acids (Δ9), 13 amino acids (Δ13), 19 amino acids (Δ19), 21 amino acids (Δ21) or 23 amino acids (Δ23) from the C-terminal end of SEQ ID NO: 1 or a relative length of another variant described herein.

The full-length SARS-CoV-2 S protein comprises a cytoplasmic tail and a transmembrane domain at the C-terminal end. In some embodiments, the SARS-CoV-2 S protein may comprise a fragment of the SARS-CoV-2 S protein lacking the cytoplasmic tail of the SARS-CoV-2 S protein. In some embodiments, the SARS-CoV-2 S protein does not comprise the entire cytoplasmic tail. In some embodiments, the SARS-CoV-2 S protein may lack a cytoplasmic tail in part or in its entirety.

In some embodiments, the SARS-CoV-2 S protein may lack the transmembrane domain of the SARS-CoV-2 S protein. The SARS-CoV-2 S protein may comprise a fragment of the SARS-CoV-2 S protein lacking the cytoplasmic tail and the transmembrane domain of the SARS-CoV-2 S protein or a variant thereof.

An ERRS (endoplasmic reticulum retention sequence (amino acids 1251-1255 of the SARS-CoV-2 S protein disclosed in Ujike, M. et al., Journal of General Virology, 97,8 (2016):1853-1864) lies within the cytoplasmic tail of the full-length SARS-CoV-2 S protein. In some embodiments, the SARS-CoV-2 S protein does not comprise ERRS in part or in its entirety.

In some embodiments, a deletion of the SARS-CoV-2 S protein occurs at position 1251 relative to SEQ ID NO: 1. In some of these embodiments, the codon encoding amino acid 1251 was changed to a stop codon, which causes amino acid 1251 and subsequent amino acids to be absent. In these embodiments, amino acid 1251 is deleted. In some embodiments, the SARS-CoV-2 S protein has a 23 amino acid deletion at the C-terminal cytoplasmic tail. In some of these embodiments, the 23 amino acid deletion includes deletion of amino acid at position 1251 relative to SEQ ID NO: 1. In some embodiments, the following amino acids are deleted from the C-terminus of SARS-CoV-2 S protein: GSCCKFDEDDSEPVLKGVKLHYT (SEQ ID NO: 193).

In some embodiments, the SARS-CoV-2 of the S protein does not comprise a 24 amino acid deletion at the C-terminal cytoplasmic tail. In some embodiments, the SARS-CoV-2 S protein does not comprise a 21-amino acid deletion at the C-terminal cytoplasmic tail.

In some embodiments, the SARS-CoV-2 S gene does not comprise a TGC to TGA mutation at nucleotide 3759. In some embodiments, the SARS-CoV-2 S protein does not comprise a cysteine to stop mutation at amino acid 1253. In some embodiments, the SARS-CoV-2 S protein does not comprise an alanine mutation at amino acid 1269 and/or 1271.

2. Optional Fusion of SARS-CoV-2 S Protein with Virus Glycoprotein

In some embodiments, the SARS-CoV-2 S protein comprises (1) a cytoplasmic tail and a transmembrane domain of a virus glycoprotein protein; and (2) a fragment of the SARS-CoV-2 S protein lacking a cytoplasmic tail and a transmembrane domain. In these embodiments, the cytoplasmic tail and the transmembrane domain of the SARS-CoV-2 S protein are replaced by the cytoplasmic tail and transmembrane domain of the virus glycoprotein protein. In some embodiments, the SARS-CoV-2 S protein may lack a SARS-CoV-2 S protein cytoplasmic tail and/or a SARS-CoV-2 S protein transmembrane domain in part or in its entirety. When expressed, the cytoplasmic tail and the transmembrane domain of the virus glycoprotein protein and the SARS-CoV-2 S protein lacking its cytoplasmic tail and transmembrane domain may form a fusion protein, wherein the cytoplasmic tail and the transmembrane domain of the SARS-CoV-2 S protein are replaced by the cytoplasmic tail and transmembrane domain of the virus glycoprotein protein. In some embodiments, the virus glycoprotein is VSV-G. Details on VSV-G are provided in Section II.C.2 below. The SARS-CoV-2 S protein may comprise the amino acid sequence in FIG. 1D, 1G, 1J, 1M, 1P, 1S or 1V (SEQ ID NO: 4, 7, 10, 13, 16, 19 or 22, respectively).

3. Optional Substitution Mutations to the SARS-CoV-2 S Protein

In many embodiments, the SARS-CoV-2 S protein may comprise at least one substitution mutation. In some embodiments, the at least one mutation relative to SEQ ID NO: 1 is along the length of the immunogenic variant.

Point mutations have been observed in the Furin cleavage site of SARS-CoV-2 S protein following passage in Vero cells, which may indicate that these point mutations are adaptive mutations to the Vero host cell line. The at least one mutation may be in the exposed loop (a solvent-exposed loop (amino acids 673-691 in SEQ ID NO: 1) that comprises the S1/S2 cleavage site (SPRRARSV, which are amino acids 680-687 in SEQ ID NO: 1, wherein cleavage occurs between R685 and S686)) of the SARS-CoV-2 S protein. Further, the at least one mutation may reduce or block S1/S2 cleavage of the SARS-CoV-2 S protein by, for example, 10%, 20%, 30%, 40%, 50%, 60%, 70%, 80%, 90%, 91%, 92%, 93%, 94%, 95%, 96%, 97%, 98%, 99%, or 100%, as compared with that of a wild-type SARS-CoV-2 S protein without the at least one mutation. The at least one mutation may be in the S2' cleavage site (Cathepsin H, L; amino acids 810-817 in SEQ ID NO: 1, wherein cleavage occurs between 815R and 816S) of the SARS-CoV-2 S protein and such at least one mutation may modulate S2' cleavage of the SARS-CoV-2 S protein by, for example, 10%, 20%, 30%, 40%, 50%, 60%, 70%, 80%, 90%, 91%, 92%, 93%, 94%, 95%, 96%, 97%, 98%, 99%, or 100%, as compared with that of a wild-type SARS-CoV-2 S protein without the at least one mutation. The at least one mutation may be in the C-terminal end of the SARS-CoV-2 S protein.

In some embodiments, the at least one mutation in the SARS-CoV-2 S protein or SEQ ID NO: 1 may be chosen from a mutation at residue 655, at least one mutation from residue 672 to residue 687, at least one mutation from residue 802 to residue 817, at least one mutation from residue 1233 to residue 1273, and combinations thereof. In some embodiments, the mutation at residue 655 in SEQ ID NO: 1 may be H655Y. In some embodiments, the at least one mutation between residues 672 and 687 in SEQ ID NO: 1 may be from residue 678 to residue 685, which may be chosen from T678I, P681S, R682K, R683G, R685G and combinations thereof. In some embodiments, the at least one mutation from residue 802 to residue 817 in SEQ ID NO: 1 may be from residue 810 to residue 815, which may be chosen from P812R, S813R, S813F and combinations thereof. In some embodiments, the at least one mutation from residue 1233 to residue 1273 in SEQ ID NO: 1 may be chosen from a deletion at the C-terminal end of the SEQ ID NO: 1, M1233K and a combination thereof.

In many embodiments, the at least one mutation in SEQ ID NO: 1, either in isolation or in any combination, comprises H655Y, R682K, R683G, N709S, S813F, N978K, S940G, D1118A, and/or D1163N.

In some embodiments, the SARS-CoV-2 S protein may further comprise at least one mutation in SEQ ID NO: 1 chosen from F140V, Q321P, N715S, D1118A and combinations thereof.

In some embodiments, the SARS-CoV-2 S protein may further comprise at least one mutation in SEQ ID NO: 1 chosen from E154D, S115L, D614G, D614N, R685G, or combinations thereof.

In some embodiments, the at least one mutation in SEQ ID NO: 1 does not comprise a mutation at R685.

C. VSV Components

1. VSV N, P, M, and L Genes

The VSV genome is composed of 5 genes encoding a VSV nucleoprotein (VSV-N), a VSV phosphoprotein (VSV-P), a VSV matrix protein (VSV-M), a VSV glycoprotein (VSV-G) and a VSV polymerase (VSV-L) and arranged sequentially 3'-N-P-M-G-L-5'. Each gene encodes a polypeptide found in mature virions In many embodiments, a recombinant VSV vector, recombinant VSV particle, or SARS-CoV-2 vaccine may comprise a modified VSV genome or at least a portion of the VSV genome. In some embodiments, the VSV genome comprises the VSV-N, VSV-P, VSV-M, and VSV-L genes or any combination thereof. In some embodiments, the VSV genome does not comprise the VSV-G gene. In some embodiments, the VSV genome may comprise at least a fragment of the VSV-G gene. VSV-G and variants thereof are described in Section II.C.2 below.

In some embodiments, the VSV genome comprises at least one mutation in at least one of the VSV genes. In many embodiments, any variant of the VSV genes or VSV proteins may be used in the recombinant VSV vector, recombinant VSV particle, immunogenic recombinant protein, or SARS-CoV-2 vaccine of the present disclosure. In some embodiments, the variant may be of equal (i.e., full-length), shorter, or longer length when compared to a wild-type protein sequence of a VSV gene. In some embodiments, the variant comprises deletions or fragments of the wild-type protein sequence of a VSV gene. In some embodiments, the variant comprises point mutations, silent mutations, synonymous mutations, nonsynonymous mutations, nonsense mutations, deletions, and/or insertions.

In some embodiments, the variant comprises at least one mutation and/or deletion relative to the wild-type VSV-M protein (SEQ ID NO: 157). In some embodiments, the VSV-M protein comprises an amino acid sequence having homology over its own length of at least 90, 91, 92, 93, 94, 95, 96, 97, 98, or 99% homology to SEQ ID NO: 151 or 157. In some embodiments, the VSV-M protein comprises Y61S. In some embodiments, the VSV-M protein or immunogenic variant thereof comprises SEQ ID NO: 151.

In some embodiments, the variant comprises at least one mutation and/or deletion relative to the wild-type VSV-L protein (SEQ ID NO: 152). In some embodiments, the VSV-L protein comprises an amino acid sequence having homology over its own length of at least 90, 91, 92, 93, 94, 95, 96, 97, 98, or 99% homology to SEQ ID NO: 152 or 158. In some embodiments, the VSV-L protein comprises a 113431 silent mutation.

In some embodiments, the modified VSV genome may comprise a foreign gene encoding the SARS-CoV-2 S protein or an immunogenic variant thereof. SARS-CoV-2 S protein and variants thereof are described in Section II.B above. Immunogenic recombinant proteins are described in Section III below.

All numbering of the VSV proteins in the disclosure and claims is relative to wildtype versions. This includes both position numbers and numbers of amino acids deleted from certain deletion mutations. Unless otherwise specified by referring to a particular variant or by specifically referring to wildtype, all references in the disclosure and claims to the VSV proteins include both the wildtype and mutant forms of the VSV proteins (including variants that have substitution mutations, insertion mutations, deletion mutations (including fragments, which are shorter in length than wildtype), and/or modifications).

2. Optional Mutations with VSV Glycoprotein

VSV-G is a transmembrane polypeptide that is present in the viral envelope as a homotrimer, and like the envelope protein, mediates cell attachment and infection. VSV-G comprises a cytoplasmic tail and a transmembrane domain at the C-terminal end. In some embodiments, the recombinant VSV vector, recombinant VSV particle, immunogenic recombinant protein, or SARS-CoV-2 vaccine of the present disclosure does not comprise a VSV-G.

In other embodiments, the recombinant VSV vector, recombinant VSV particle, immunogenic recombinant protein, or SARS-CoV-2 vaccine comprises a VSV-G gene/ protein or at least a fragment thereof. In some embodiments, the VSV-G protein or fragment thereof is covalently linked to a SARS-CoV-2 S protein. Details relating to recombinant VSV vectors and recombinant VSV particles are provided in Section II.A above. Details relating to immunogenic recombinant proteins are provided in Section III below. Details relating to vaccines are provided in Section IV.A below. The VSV-G variant may be a fragment of the VSV-G nucleotide sequence or a fragment of the VSV-G amino acid sequence, wherein the nucleotide or amino acid sequence may have at least one modification (e.g., deletion, addition, or substitution). In some embodiments, the cytoplasmic tail is absent, in part or in its entirety, from the VSV-G. In some embodiments, the cytoplasmic tail and the transmembrane domain are absent, in part or in their entirety, from the VSV-G.

In some embodiments, the VSV-G gene encodes a cytoplasmic tail of a VSV-G protein and/or a transmembrane domain of a VSV-G protein. In some embodiments, the VSV-G protein comprises a fragment of at least 21 amino acids at the C-terminal end of full-length VSV-G protein; or a fragment of at least 29 amino acids at the C-terminal end of full-length VSV-G protein. In some embodiments, the fragment of the VSV-G protein may comprise from 21 to 29 amino acids at the C-terminal end of the full-length VSV-G protein.

In some embodiments, the recombinant VSV vector, recombinant VSV particle, or SARS-CoV-2 vaccine comprises a fusion gene wherein a fragment of VSV-G gene is operably linked to nucleotide sequence encoding a fragment of SARS-CoV-2 S protein. In related embodiments, the recombinant VSV particle or SARS-CoV-2 vaccine comprises a fusion protein, wherein the VSV-G protein is expressed as a fragment that is covalently linked to a SARS-CoV-2 S protein fragment. In these embodiments, as described in detail in Section II.B.2 above, the SARS-CoV-2 S protein fragment lacks a SARS-CoV-2 S protein cytoplasmic tail and a SARS-CoV-2 S protein transmembrane domain, and has a VSV-G cytoplasmic tail and VSV-G transmembrane domain instead.

D. Arrangement of Elements in a Recombinant VSV Vector

In the recombinant VSV vector of the present disclosure, the modified VSV genome may comprise VSV genes, such as the VSV-N, VSV-P, VSV-M, and VSV-L genes or any combination thereof. These VSV-N, VSV-P, VSV-M, and VSV-L genes may be arranged in sequence from 3' end to 5' end. The foreign gene may be at any location in the modified VSV genome. For example, the foreign gene may be inserted on the 3' end of the VSV-N gene, between the VSV-N gene and the VSV-P gene, between the VSV-P gene and the VSV-M gene, between the VSV-M gene and the VSV-L gene, or on the 5' end of the VSV-L gene.

In some embodiments, the foreign gene is a nucleotide sequence encoding the SARS-CoV-2 S protein or immunogenic variant thereof. In a recombinant VSV vector, the VSV genes and the SARS-CoV-2 S protein or immunogenic variant thereof may be arranged in a variety of ways. In some embodiments, the nucleic acid sequence encoding the SARS-COV-2 S protein or an immunogenic variant thereof is 3' of the VSV-N gene. In some embodiments, the nucleic acid sequence encoding the SARS-COV-2 S protein or an immunogenic variant thereof is on the 3' end of the VSV-N gene. In some embodiments, the nucleic acid sequence encoding the SARS-COV-2 S protein or an immunogenic variant thereof is between the VSV-N gene and the VSV-P gene. In some embodiments, the nucleic acid sequence encoding the SARS-COV-2 S protein or an immunogenic variant thereof is between the VSV-P gene and the VSV-M gene. In some embodiments, the SARS-COV-2 S protein or an immunogenic variant thereof is between the VSV-M gene and the VSV-L gene. In some embodiments, the nucleic acid sequence encoding the SARS-COV-2 S protein or an immunogenic variant thereof is 5' of the VSV-L gene. In some embodiments, the nucleic acid sequence encoding the SARS-COV-2 S protein or an immunogenic variant thereof is on the 5' end of the VSV-L gene.

E. Exemplary Variants of the SARS-CoV-2 S Protein and VSV Proteins

The recombinant VSV vectors, recombinant VSV particles, immunogenic recombinant proteins, and SARS-CoV-2 vaccines of the present disclosure may comprise one of the following exemplary mutants of the SARS-CoV-2 S protein (SEQ ID NO: 1):

(1) H655Y, R682K, and R685G;
(2) H655Y, R682K, R685G, and a deletion of the 9 amino acids ($\Delta$9) at the C-terminal end of the amino acid sequence of SEQ ID NO: 1;
(3) H655Y, R682K, R685G, and a deletion of the 13 amino acids ($\Delta$13) at the C-terminal end of the amino acid sequence of SEQ ID NO: 1;
(4) Q321P, H655Y, T678I, and P812R;
(5) Q321P, H655Y, T678I, P812R, and a deletion of the 23 amino acids ($\Delta$23) at the C-terminal end of the amino acid sequence of SEQ ID NO: 1;
(6) E154D, S155L, T678I, R685G, and M1233K;
(7) R685G, S813R, and a deletion of the 9 amino acids ($\Delta$9) at the C-terminal end of the amino acid sequence of SEQ ID NO: 1;
(8) H655Y, R682K, and a deletion of the 13 amino acids ($\Delta$13) at the C-terminal end of the amino acid sequence of SEQ ID NO: 1;
(9) R685G, S813F, and a deletion of the 9 amino acids ($\Delta$9) at the C-terminal end of the amino acid sequence of SEQ ID NO: 1;
(10) R683G, S813F and a deletion of the 23 amino acids ($\Delta$23) at the C-terminal end of the amino acid sequence of SEQ ID NO: 1;
(11) R683G, S813F, R685G, and a deletion of 23 amino acids ($\Delta$23) at the C-terminal end of the amino acid sequence of SEQ ID NO: 1;
(12) H655Y, P681S, R682K, and a deletion of the 13 amino acids ($\Delta$13) at the C-terminal end of the amino acid sequence of SEQ ID NO: 1;
(13) R683G and a deletion of the 23 amino acids ($\Delta$23) at the C-terminal end of the amino acid sequence of SEQ ID NO: 1;
(14) H655Y and a deletion of the 23 amino acids ($\Delta$23) at the C-terminal end of the amino acid sequence of SEQ ID NO: 1;
(15) R683G, D1118A, and a deletion of the 23 amino acids ($\Delta$23) at the C-terminal end of the amino acid sequence of SEQ ID NO: 1;
(16) R683G, N715S, and a deletion of the 23 amino acids ($\Delta$23) at the C-terminal end of the amino acid sequence of SEQ ID NO: 1;
(17) H655Y, N709S, and a deletion of the 13 amino acids ($\Delta$13) at the C-terminal end of the amino acid sequence of SEQ ID NO: 1;
(18) F140V, H655Y and a deletion of the 23 amino acids ($\Delta$23) at the C-terminal end of the amino acid sequence of SEQ ID NO: 1;
(19) a deletion of the 21 amino acids ($\Delta$21) at the C-terminal end of the amino acid sequence of SEQ ID NO: 1;
(20) a deletion of the 19 amino acids ($\Delta$19) at the C-terminal end of the amino acid sequence of SEQ ID NO: 1, wherein the SARS-CoV-2 S protein further comprises a fragment of at least 21 amino acids at the C-terminal end of a VSV-G protein;
(21) E484D, H655Y, and a deletion of 21 amino acids ($\Delta$21) at the C-terminal end of the amino acid sequence of SEQ ID NO: 1;
(22) H665Y, R685G and a deletion of the 19 amino acids ($\Delta$19) at the C-terminal end of the amino acid sequence of SEQ ID NO: 1, wherein the SARS-CoV-2 S protein further comprises a fragment of at least 21 amino acids at the C-terminal end of a VSV-G protein;
(23) D614G; or
(24) D614N.

In addition to an exemplary mutant of SARS-CoV-2 S protein, the recombinant VSV vectors, recombinant VSV particles, immunogenic recombinant proteins, and SARS-CoV-2 vaccines of the present disclosure may comprise any or all of the following exemplary mutants of the VSV proteins:

(1) Y61S in VSV-M;
(2) E213K in VSV-M; and/or
(3) V411M in VSV-L.

F. Exemplary Recombinant VSV Vectors

In many embodiments, the recombinant VSV vectors, recombinant VSV particles, and SARS-CoV-2 vaccines of the present disclosure may comprise a modified VSV genome and a nucleotide sequence encoding SARS-CoV-2 S protein or immunogenic variant thereof, arranged in a variety of ways on a VSV vector backbone. Details and variants relating to modified VSV genomes and VSV components; and SARS-CoV-2 S proteins are described in Sections II.A.1 and II.C; and II.B, respectively. In some embodiments, the recombinant VSV vectors, recombinant VSV particles, and SARS-CoV-2 vaccines do not comprise VSV-G. In other embodiments, the recombinant VSV vectors, VSV particles, and SARS-CoV-2 vaccines may comprise VSV-G or a fragment thereof.

In some embodiments, the recombinant VSV vector, recombinant VSV particle, or SARS-CoV-2 vaccine comprises R683G, S813F and a deletion of the 23 amino acids ($\Delta$23) at the C-terminal end of the amino acid sequence of SEQ ID NO: 1; and Y61S in VSV-M. In some embodiments, the recombinant VSV vector is rVSV$\Delta$G-SARS-CoV-2 clone MB1 (which has the nucleic acid sequence SEQ ID NO: 150; amino acid sequences SEQ ID NOS: 151-153, 155, and 156; and FIGS. 24A-G). The recombinant VSV vector rVSV$\Delta$G-SARS-CoV-2 clone MB1 does not comprise VSV-G. In some embodiments with these mutations, the recombinant VSV vector, particle, or vaccine does not comprise VSV-G in its entirety, but comprises it in part, such as the 21 amino acids of the cytoplasmic tail.

In some embodiments, the recombinant VSV vector, recombinant VSV particle, or SARS-CoV-2 vaccine comprises H655Y and a deletion of the 23 amino acids ($\Delta$23) at the C-terminal end of the amino acid sequence of SEQ ID NO: 1. In some embodiments, the recombinant VSV vector is rVSV$\Delta$G-SARS-CoV-2 clone MB2 (which has the nucleic acid sequence SEQ ID NO: 154; amino acid sequences SEQ ID NOS: 152, 155, 156, 157, and 158; FIGS. 21A-G). The recombinant VSV vector rVSV$\Delta$G-SARS-CoV-2 clone MB2 does not comprise VSV-G. In some embodiments with these mutations, the recombinant VSV vector, particle, or vaccine does not comprise VSV-G in its entirety, but comprises it in part, such as the 21 amino acids of the cytoplasmic tail.

III. Immunogenic Recombinant Proteins

The recombinant VSV vectors, recombinant VSV particles, immunogenic recombinant proteins, or SARS-CoV-2 vaccines of the present disclosure may produce or comprise an immunogenic recombinant protein. An immunogenic recombinant protein is capable of inducing an immune response in a subject administered the immunogenic recombinant protein. In some embodiments, the immunogenic recombinant protein may induce an immune response capable of blocking at least 10%, 20%, 30%, 40%, 50%, 60%, 70%, 80%, 90%, 91%, 92%, 93%, 94%, 95%, 96%, 97%, 98%, 99% or 100% of SARS-CoV-2 infection in a subject administered the immunogenic recombinant protein as compared with a control subject not administered the immunogenic recombinant protein. The term "immunogenic variant" refers to a variant of an immunogenic protein that induces at least a portion of the immune response of the wild-type protein. In some embodiments, the variant is an immunogenic variant that induces a relevant immune response in vaccinated individuals to enable protection against COVID-19. In some embodiments, the immunogenic variant may induce an immune response capable of blocking at least 10%, 20%, 30%, 40%, 50%, 60%, 70%, 80%, 90%, 91%, 92%, 93%, 94%, 95%, 96%, 97%, 98%, 99%, or 100% of a SARS-CoV-2 infection in a subject administered with the immunogenic variant as compared with a control subject administered the SARS-CoV-2 S protein. In some embodiments, the variant comprises a sequence that shares homology with the wild-type SARS-CoV-2 S protein (SEQ ID NO: 1), wherein homology is at least 90% similarity with the variant as the reference protein sequence.

In some embodiments, the immunogenic recombinant protein is a variant that may have an amino acid length that is the same as or a fragment of the full-length of the immunogenic recombinant protein. In many embodiments, the immunogenic recombinant protein may comprise a full-length SARS-CoV-2 S protein, fragments thereof, or mutant variants thereof, that are expressed by the recombinant VSV vector or recombinant VSV particle of the present disclosure. In embodiments where the immunogenic recombinant protein is not the full-length or wild-type SARS-CoV-2 S protein, the immunogenic recombinant protein is an immunogenic variant of the SARS-CoV-2 S protein. Details on full-length SARS-CoV-2 S protein, fragments thereof, and mutants thereof are provided in Section II.B above. Details on recombinant VSV vectors and recombinant VSV particles are provided in Section II.A above.

In some embodiments, the immunogenic variant is a fragment of the SARS-CoV-2 S protein having a deletion at the C-terminal end. In some embodiments, distinct domain of the SARS-CoV-2 S protein are removed to produce an immunogenic variant. In other embodiments, specific fragment lengths are deleted from the SARS-CoV-2 S protein. The distinct domains and specific fragments are discussed in Section II.B above.

The immunogenic variant of the SARS-CoV-2 S protein may comprise a fragment of the SARS-CoV-2 S protein or a variant thereof (the SARS-CoV-2 S protein fragment), and a portion of a VSV-G or a variant thereof (the VSV-G protein portion). In some embodiments, the SARS-CoV-2 S protein fragment lacks the cytoplasmic tail of the SARS-CoV-2 S protein, and the VSV-G protein portion comprises the cytoplasmic tail of the VSV-G protein. In some embodiments, the SARS-CoV-2 S protein may lack a cytoplasmic tail in part or in its entirety. In another embodiment, the SARS-CoV-2 S protein fragment lacks the cytoplasmic tail and the transmembrane domain of the SARS-CoV-2 S protein, and the VSV-G protein portion comprises the cytoplasmic tail and the transmembrane domain of the VSV-G protein. Details on the VSV-G protein are provided above in Section II.C.2.

In some embodiments, the immunogenic recombinant protein comprises VSV and SARS-CoV-2 proteins in rVSVΔG-SARS-CoV-2 clone MB1 (specifically amino acid SEQ ID NOS: 151-153, 155, and 156) or VSV and SARS-CoV-2 protein in rVSVΔG-SARS-CoV-2 clone MB2 (specifically amino acid SEQ ID NOS: 152 and 155-158).

In some embodiments, the SARS-CoV-2 vaccine comprises rVSVΔG-SARS-CoV-2 clone MB1 (nucleic acid sequence SEQ ID NO: 150; or amino acid sequences SEQ ID NO: 151-153, 155, and 156:) or rVSVΔG-SARS-CoV-2 clone MB2 (nucleic acid sequence SEQ ID NO: 154; or amino acid sequences SEQ ID NO: 155-158, and 152). Details on rVSVΔG-SARS-CoV-2 clones MB1 and MB2 are provided in Section II.F above.

IV. Pharmaceutical Compositions

The present disclosure further provides pharmaceutical compositions that may comprise any recombinant VSV vector, recombinant VSV particle, immunogenic recombinant protein, or SARS-CoV-2 vaccine of the present disclosure. Recombinant VSV vectors and VSV particles are described in Section II.A above while the VSV components are described in Section II.C above. The SARS-CoV-2 S protein and variants thereof are described in Section II.B above, while immunogenic variants are described in Section III above.

The recombinant VSV vector, recombinant VSV particle, immunogenic recombinant protein, or SARS-CoV-2 vaccine may be produced according to the methods disclosed herein and provided to a pharmaceutical composition. In particular, methods for producing recombinant VSV particles are described in Section V below.

In some embodiments, the pharmaceutical composition comprises an effective amount of a recombinant VSV vector, recombinant VSV particle, immunogenic recombinant protein, and/or SARS-CoV-2 vaccine to generate an immune response against SARS-CoV-2 in a subject. In some embodiments, the pharmaceutical composition is a vaccine composition. In many embodiments, the pharmaceutical composition, including a vaccine composition, comprises at least one pharmaceutical excipient.

The pharmaceutical composition, including a vaccine composition, may be formulated for oral (including oral mucosal, buccal, and/or gastrointestinal) sublingual, intramuscular, intradermal, subcutaneous, intranasal (including nasal mucosal), intraocular, rectal, transdermal, mucosal, topical, intravenous, or parenteral administration.

The pharmaceutical compositions of the disclosure may be injectable suspensions, solutions, sprays, lyophilized powders, syrups, elixirs and the like. Any suitable form of pharmaceutical composition may be used. To prepare such a pharmaceutical composition, a nucleic acid molecule or vector of the disclosure, having the desired degree of purity, is mixed with one or more pharmaceutically acceptable carriers and/or excipients. The carriers and excipients must be "acceptable" in the sense of being compatible with the other ingredients of the composition. Acceptable carriers, excipients, or stabilizers are nontoxic to recipients at the dosages and concentrations employed, and include, but are not limited to, water, saline, phosphate buffered saline, dextrose, glycerol, ethanol, or combinations thereof, buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than 10 residues) polypeptide; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or nonionic surfactants such as TWEEN™, PLURONICS™ or polyethylene glycol (PEG).

The pharmaceutical composition may be an immunogenic or immunological composition. The pharmaceutical composition can be formulated in the form of an oil-in-water emulsion. The oil-in-water emulsion can be based, for example, on light liquid paraffin oil (European Pharmacopea type); isoprenoid oil such as squalane, squalene, EICOSANE™ or tetratetracontane; oil resulting from the oligomerization of alkene(s), e.g., isobutene or decene; esters of acids or of alcohols containing a linear alkyl group, such as plant oils, ethyl oleate, propylene glycol di(caprylate/caprate), glyceryl tri(caprylate/caprate) or propylene glycol dioleate; esters of branched fatty acids or alcohols, e.g., isostearic acid esters. The oil advantageously is used in combination with emulsifiers to form the emulsion. The emulsifiers can be nonionic surfactants, such as esters of sorbitan, mannide (e.g., anhydromannitol oleate), glycerol, polyglycerol, propylene glycol, and oleic, isostearic, ricinoleic, or hydroxystearic acid, which are optionally ethoxylated, and polyoxypropylene-polyoxyethylene copolymer blocks, such as the Pluronic® products, e.g., L121.

The pharmaceutical composition of the disclosure can contain additional substances, such as wetting or emulsifying agents, buffering agents, or adjuvants to enhance the effectiveness of the vaccines (Remington's Pharmaceutical Sciences, 18th edition, Mack Publishing Company, (ed.) 1980).

Adjuvants may also be included. As used herein, the term "adjuvant" refers to a composition or compound that is capable of enhancing the immune response against an antigen of interest. Adjuvants are substances or combinations of substances that are used in conjunction with a vaccine antigen to enhance (e.g., increase, accelerate, prolong and/or possibly target) or modulate to a different type (e.g., switch a Th1 immune response to a Th2 response, or a humoral response to a cytotoxic T cell response) the specific immune response to the vaccine antigen in order to enhance the clinical effectiveness of the vaccine. In some embodiments, the adjuvant may modify (Th1/Th2) the immune response. In some embodiments, the adjuvant may boost the strength and longevity of the immune response. In some embodiments, the adjuvant may broaden the immune response to a concomitantly administered antigen. In some embodiments, the adjuvant may be capable of inducing strong antibody and T cell responses. In some embodiments, the adjuvant may be capable of increasing the polyclonal ability of the induced antibodies. In some embodiments, the adjuvant may be used to decrease the amount of antigen necessary to provoke the desired immune response and provide protection against the disease. In some embodiments, the adjuvant may be used to decrease the number of injections needed in a clinical regimen to induce a durable immune response and provide protection against the disease. Adjuvant containing formulations described herein may demonstrate enhancements in humoral and/or cellular immunogenicity of vaccine antigens, for example, subunit vaccine antigens. Adjuvants of the present invention are not used to deliver antigens, antibodies, APIs, or VLPs.

Adjuvants include, but are not limited to, mineral salts (e.g., $AlK(SO_4)_2$, $AlNa(SO_4)_2$, $AlNH(SO_4)_2$, silica, alum, $Al(OH)_3$, $Ca_3(PO_4)_2$, kaolin, or carbon), polynucleotides with or without immune stimulating complexes (ISCOMs) (e.g., CpG oligonucleotides, such as those described in Chuang, T. H. et al, (2002) J. Leuk. Biol. 71(3): 538-44; Ahmad-Nejad, P. et al (2002) Eur. J. Immunol. 32(7): 1958-68; poly IC or poly AU acids, polyarginine with or without CpG (also known in the art as IC31; see Schellack, C. et al (2003) Proceedings of the 34th Annual Meeting of the German Society of Immunology; Lingnau, K. et al (2002) Vaccine 20(29-30): 3498-508), JuvaVax™ (U.S. Pat. No. 6,693,086), certain natural substances (e.g., wax D from *Mycobacterium tuberculosis*, substances found in *Cornyebacterium parvum, Bordetella pertussis*, or members of the genus *Brucella*), flagellin (Toll-like receptor 5 ligand; see McSorley, S. J. et al (2002) J. Immunol. 169(7): 3914-9), saponins such as QS21, QS17, and QS7 (U.S. Pat. Nos. 5,057,540; 5,650,398; 6,524,584; 6,645,495), monophosphoryl lipid A, in particular, 3-de-O-acylated monophosphoryl lipid A (3D-MPL), imiquimod (also known in the art as IQM and commercially available as Aldara®; U.S. Pat. Nos. 4,689,338; 5,238,944; Zuber, A. K. et al (2004) 22(13-14): 1791-8), and the CCR5 inhibitor CMPD167 (see Veazey, R. S. et al (2003) J. Exp. Med. 198: 1551-1562). The adjuvant can be a mixture of emulsifier(s), micelle-forming agent, and oil such as that which is commercially available under the name Provax® (IDEC Pharmaceuticals, San Diego, Calif.).

Aluminum hydroxide or phosphate (alum) are commonly used at 0.05 to 0.1% solution in phosphate buffered saline. Other adjuvants that can be used with DNA vaccine, are cholera toxin, CTA1-DD/ISCOMs (see Mowat, A. M. et al (2001) J. Immunol. 167(6): 3398-405), polyphosphazenes (Allcock, H. R. (1998) App. Organometallic Chem. 12(10-11): 659-666; Payne, L. G. et al (1995) Pharm. Biotechnol. 6: 473-93), cytokines such as, but not limited to, IL-2, IL-4, GM-CSF, IL-12, IL-15 IGF-1, IFN-α, IFN-β, and IFNγ (Boyer et al., (2002) J. Liposome Res. 121:137-142; WO01/095919), immunoregulatory proteins such as CD40L (ADX40; see, for example, WO03/063899), and the CD1a ligand of natural killer cells (also known as CRONY or α-galactosyl ceramide; see Green, T. D. et al, (2003) J. Virol. 77(3): 2046-2055), immunostimulatory fusion proteins such as IL-2 fused to the Fc fragment of immunoglobulins (Barouch et al., Science 290:486-492, 2000) and co-stimulatory molecules B7.1 and B7.2 (Boyer), all of which can be administered either as proteins or in the form of DNA, on the same expression vectors as those encoding the antigens of the disclosure or on separate expression vectors.

In an advantageous embodiment, the adjuvants may be lecithin is combined with an acrylic polymer (Adjuplex-LAP), lecithin coated oil droplets in an oil-in-water emulsion (Adjuplex-LE) or lecithin and acrylic polymer in an oil-in-water emulsion (Adjuplex-LAO) (Advanced BioAdjuvants (ABA)).

The compositions can be designed to introduce the nucleic acid molecules or expression vectors to a desired site of action and release them at an appropriate and controllable rate. Methods of preparing controlled-release formulations are known in the art. For example, controlled release preparations can be produced by the use of polymers to complex or absorb the immunogen and/or immunogenic composition. A controlled-release formulation can be prepared using appropriate macromolecules (for example, polyesters, polyamino acids, polyvinyl, pyrrolidone, ethylenevinylacetate, methylcellulose, carboxymethylcellulose, or protamine sulfate) known to provide the desired controlled release characteristics or release profile. Another possible method to control the duration of action by a controlled-release preparation is to incorporate the active ingredients into particles of a polymeric material such as, for example, polyesters, polyamino acids, hydrogels, polylactic acid, polyglycolic acid, copolymers of these acids, or ethylene vinylacetate copolymers. Alternatively, instead of incorporating these active ingredients into polymeric particles, it is possible to entrap these materials into microcapsules prepared, for example, by coacervation techniques or by interfacial polymerization, for example, hydroxymethylcellulose or gelatin-microcapsule and poly-(methylmethacrylate) microcapsule, respectively, in colloidal drug delivery systems (for example, liposomes, albumin microspheres, microemulsions, nano-particles and nanocapsules) or in macroemulsions. Such techniques are disclosed in New Trends and Developments in Vaccines, Voller et al. (eds.), University Park Press, Baltimore, Md., 1978 and Remington's Pharmaceutical Sciences, 16th edition.

A. SARS-CoV-2 Vaccine

The vectors and viral particles of the present disclosure are useful for providing vaccines for delivering the nucleic acids encoding the proteins of the disclosure to a subject, such as a human, such that the proteins are then expressed in the subject to elicit an immune response. A vaccine may comprise recombinant VSV vector, VSV particle, a SARS-CoV-2 S protein, and/or an immunogenic recombinant variant thereof. Recombinant VSV vectors and VSV particles are described in Section II.A above while the VSV components are described in Section II.C above. The SARS-CoV-2 S protein and variants thereof are described in Section II.B above, while immunogenic variants are described in Section III above. Details on methods of administration are provided in Section VII.A below. Immunogenic compositions are also encompassed by the use of the term vaccine throughout the disclosure and claims.

V. Methods for Producing a Recombinant VSV Particles

Methods for producing a recombinant VSV particle may comprise introducing into cells a recombinant VSV vector of present disclosure such that a recombinant VSV particle is produced. Alternatively, the methods may comprise infecting cells with a recombinant VSV particle of the present disclosure, and then producing a recombinant VSV particle. In some embodiments, the methods further comprise expressing a SARS-CoV-2 S protein or an immunogenic variant thereof, wherein the SARS-CoV-2 S protein or immunogenic variant thereof may be presented on the surface of the recombinant VSV particle. Details on the recombinant VSV particle are provided in Section II.A.

The cells that may be used in a variety of embodiments are Vero cells, human 293 cells, MRC-5 cells, Vero E6 cells, Huh7 cells, DBT cells, Calu-3 2B4 cells or primary human airway epithelial cells. In some embodiments, the cell is a Vero cell.

The methods may further comprise purifying the recombinant VSV particle from the cells. The methods may further comprise purifying the SARS-CoV-2 S protein or immunogenic variant thereof from the cells. The methods may also comprise purifying the recombinant VSV vector from the cells.

A method of producing an adaptive mutant of the recombinant VSV particle of the present disclosure is provided. The term "adaptive mutation" used herein refers to a process that produces mutations in a virus or viral particle in response to one or more nonlethal selections and the resulting adaptive mutant virus or viral particle may have an improved biological property (e.g., replication capacity). For example, one or more mutations in a recombinant VSV particle (e.g., VSVΔG-SARS-CoV-2 chimera) may occur due to a change in one or more environmental factors (e.g., temperature, host cells and culture medium), which may reduce replication capacity of the recombinant VSV particle. The adaptive mutations may include at least one amino acid modified, for example, deleted, inserted, or replaced, and can be detected by conventional technologies. An adaptive mutant of the recombinant VSV may exhibit greater replication capacity than the recombinant VSV by, for example, at least 10%, 20%, 30%, 40%, 50%, 60%, 70%, 80%, 90%, 100%, 150% or 200%.

The method of producing an adaptive mutant may comprise replicating the recombinant VSV particle in a cell culture, changing a condition of the cell culture, identifying a mutant of the recombinant VSV particle exhibiting a better desirable property than the recombinant VSV particle. As result, an adaptive mutant of the recombinant VSV particle is obtained. The desirable property may be increased immunogenicity, as evidenced by, for example, greater replication capacity and/or increased expression of the SARS-CoV-2 S protein or an immunogenic fragment thereof. The condition may be chosen from of temperature, culture medium and cell substrates. For example, the temperature of the cell culture may be changed from a range of 30-36° C. to a range of 38-40° C. The culture medium may be changed from complete medium containing 10% fetal bovine serum to complete medium containing lower quantities of serum like 2% or to alternative mediums like serum-free growth medium. Where the desirable property is replication capacity, the adaptive mutant may exhibit at least 10%, 20%, 30%, 40%, 50%, 60%, 70%, 80%, 90%, 100%, 150% or 200% greater replication capacity than the recombinant VSV particle. The adaptive method may further comprise subjecting the recombinant VSV particle to mutagenesis prior to growing the recombinant VSV particle in the cell culture. The mutagenesis may be chemical.

VI. Recombinant Cells

In many embodiments, a recombinant cell comprises a recombinant VSV vector and/or a recombinant VSV particle. In some embodiments, the recombinant cell produces a recombinant VSV particle. A SARS-CoV-2 S protein or a variant thereof is expressed on the surface of the recombinant VSV particle. Cells that may be used as recombinant cells are chosen from Vero cells, human 293 cells, MRC-5 cells, Vero E6 cells, Huh7 cells, DBT cells, Calu-3 2B4 cells, and primary human airway epithelial cells. In many embodiments, the recombinant cell is a Vero cell.

VII. Methods of Generating an Immune Response Against SARS-CoV-2

In many embodiments, an effective amount of a recombinant VSV vector, recombinant VSV particle, immunogenic recombinant protein, or SARS-CoV-2 vaccine of the present disclosure is administered in vivo, for example, to produce an immune response in a subject. The recombinant VSV vector, recombinant VSV particle, immunogenic recombinant protein, or SARS-CoV-2 vaccine may be used as one or more components of a prophylactic or therapeutic vaccine against SARS-CoV-2 for the prevention, amelioration or treatment of COVID-19. The term "immune response" used herein refers to any immune response, including but not limited to a humoral response, a cellular antigen-specific immune response, or a combination thereof. A "subject" in the context of the present disclosure may be any animal, for example, a human. In some embodiments the subject is a human, for example, a human that is infected with, or is at risk of infection with, SARS-CoV-2.

In some embodiments, the immune response may block infection by SARS-CoV-2 of a subject administered the SARS-CoV-2 S protein or an immunogenic variant thereof by, for example, 10%, 20%, 30%, 40%, 50%, 60%, 70%, 80%, 90%, 95%, 99% or 100%, as compared with that of a control subject not administered the SARS-CoV-2 S protein or an immunogenic variant thereof. Generation of an immune response includes both immune responses generated after one dose, as well as immune responses generated after two or more doses. Thus, an immune response may occur after administration of a first vaccine or a first vaccine and a second vaccine.

Methods of generating an immune response against SARS-CoV-2 may comprise (1) administering to the subject an effective amount of the VSV vector, recombinant VSV particle, immunogenic recombinant protein, or SARS-CoV-2 vaccine of the present disclosure; and (2) generating an immune response to SARS-CoV-2. In some embodiments, the immune response is generated in the subject without causing a disease or symptom associated with the SARS-CoV-2 and the subject is vaccinated. A disease or symptom associated with the SARS-CoV-2 may be fever, cough, shortness of breath, or gastrointestinal symptoms.

The immune response may comprise a humoral response, a cellular antigen-specific immune response or a combination thereof. Anti-SARS-CoV-2 antibodies may be isolated from a COVID-19 or produced by immunizing a subject with a SARS-CoV-2 epitope. Where the immune response comprises production of antibodies by the subject that block SARS-CoV-2 infection, the methods may further comprise harvesting the antibodies from the vaccinated subject, and optionally mixing the harvested antibodies with a pharmaceutically acceptable excipient to make a pharmaceutical composition. In some embodiments, the antibodies are in the form of immune serum obtained from the vaccinated subject. The antibodies may be in the form of immune serum obtained from vaccinated subjects or monoclonal antibodies prepared from SARS-CoV-2-specific B cells obtained from vaccinated subject.

When provided prophylactically, the VSV vector, recombinant VSV particle, immunogenic recombinant protein, or SARS-CoV-2 vaccine of the present disclosure are ideally administered to a subject in advance of SARS-CoV-2 infection or evidence of SARS-CoV-2 infection, or in advance of any symptom due to COVID-19, including high-risk subjects. The prophylactic administration of the VSV vector, recombinant VSV particle, immunogenic recombinant protein, or SARS-CoV-2 vaccine can serve to provide protective immunity of a subject against SARS-CoV-2 infection or to prevent or attenuate the progression of COVID-19 in a subject already infected with SARS-CoV-2.

When provided therapeutically (i.e., after the subject is exposed to SARS-CoV-2 and either before or after the onset of symptoms), the VSV vector, recombinant VSV particle, immunogenic recombinant protein, or SARS-CoV-2 vaccine can serve to ameliorate and treat COVID-19 symptoms and are advantageously used as soon after infection as possible. In some embodiments, the VSV vector, recombinant VSV particle, immunogenic recombinant protein, or SARS-CoV-2 vaccine are provided before appearance of any symptoms of COVID-19 but may also be used at (or after) the onset of the disease symptoms. In some embodiments, the method further comprises preventing or inhibiting binding of SARS-CoV-2 to the receptor. In some embodiments, the receptor is angiotensin-converting enzyme 2 (ACE2).

In some embodiments, the methods may comprise administering the VSV vector, recombinant VSV particle, immunogenic recombinant protein, or SARS-CoV-2 vaccine to a tissue in the subject that expresses a receptor for SARS-CoV-2, that may comprise ACE2. These methods may prevent or inhibit SARS-CoV-2 from binding to the receptor after the subject is exposed to the SARS-CoV-2. The target tissue may be in the gastrointestinal tract, such as the small intestine, of the subject.

A. Methods of Administration

Any suitable method may be used to administer the VSV vector, recombinant VSV particle, immunogenic recombinant protein, or SARS-CoV-2 vaccine, including but not limited to for oral (including oral mucosal, buccal, and/or gastrointestinal) sublingual, intramuscular, intradermal, subcutaneous, intranasal (including nasal mucosal), intraocular, rectal, transdermal, mucosal, topical, intravenous, or parenteral delivery methods. Other delivery methods of DNA to animal tissue have been achieved by cationic liposomes (Watanabe et al., (1994) Mol. Reprod. Dev. 38:268-274; and WO 96/20013), direct injection of naked DNA into animal muscle tissue (Robinson et al., (1993) Vaccine 11:957-960; Hoffman et al., (1994) Vaccine 12: 1529-1533; Xiang et al., (1994) Virology 199: 132-140; Webster et al., (1994) Vaccine 12: 1495-1498; Davis et al., (1994) Vaccine 12: 1503-1509; and Davis et al., (1993) Hum. Mol. Gen. 2: 1847-1851), or intradermal injection of DNA using "gene gun" technology (Johnston et al., (1994) Meth. Cell Biol. 43:353-365). Alternatively, delivery routes can be oral, intranasal or by any other suitable route. Delivery also be accomplished via a mucosal surface such as the anal, vaginal, or oral mucosa.

In some embodiments, the VSV vector, recombinant VSV particle, immunogenic recombinant protein, or SARS-CoV-2 vaccine is administered orally or oral mucosally. Oral or oral mucosal administration of the vaccine would greatly simplify the production, formulation, packaging and delivery of the vaccine and thus greatly facilitate the implementation and reach of vaccination programs worldwide. Notably, this method can simplify mass vaccination by allowing use of needle-free devices. In addition, the vaccine compositions of the present disclosure administered mucosally require less extensive purification simplifying vaccine manufacturing. Lastly, mucosal vaccine composition of the present disclosure is known to stimulate greater protective immunity at mucosal barriers where most infectious pathogens gains access to the host. Accordingly, one embodiment of the present disclosure is a vaccine composition that is suitable for oral or oral mucosal vaccination. Oral or oral mucosal administration of this vaccine is supported by the high-level expression of ACE2 and Furin (which facilitate viral infection) at mucosal surfaces including those of the oropharyngeal cavity. In yet another embodiment, the VSV vector, recombinant VSV particle, immunogenic recombinant protein, or SARS-CoV-2 vaccine is administered orally or oral mucosally so that may target gastrointestinal mucosa.

In some embodiments, the VSV vector, recombinant VSV particle, immunogenic recombinant protein, or SARS-CoV-2 vaccine is formulated for oral administration. In some embodiments, the VSV vector, recombinant VSV particle, immunogenic recombinant protein, or SARS-CoV-2 vaccine is formulated for intranasal administration. In some embodiments, the VSV vector, recombinant VSV particle, immunogenic recombinant protein, or SARS-CoV-2 vaccine formulated for oral mucosal administration and intranasal administration combined (a dual route of administration).

In some embodiments, administering the recombinant VSV vector, recombinant VSV particle, immunogenic recombinant protein, or SARS-CoV-2 vaccine comprises intranasal administration. In some embodiments, administering the recombinant VSV vector, recombinant VSV particle, immunogenic recombinant protein, or SARS-CoV-2 vaccine comprises oral administration. In some embodiments, administering the recombinant VSV vector, recombinant VSV particle, immunogenic recombinant protein, or SARS-CoV-2 vaccine comprises oral mucosal and intranasal administration combined (a dual route of administration).

B. Subjects

The subject may be a male or female. The subject may be of all ages. The subject may be younger than 10, 10 or older than 10, 20, 30, 40, 50, 60, 70 or 80 years old. The subject may be 0-10, 10-20, 20-30, 30-40, 40-50, 50-60, 60-70, 70-80, 80-90 or 90-100 years old. The subject may have a pre-existing medical condition, including without limitation, serious chronic medical condition. The pre-existing medical condition may be chosen from asthma, blood or bone marrow transplant, cancer, cardiomyopathy, cerebrovascular disease, chronic kidney disease, chronic obstructive pulmonary disease, coronary artery disease, cystic fibrosis, diabetes (including type 1 diabetes mellitus and type 2 diabetes mellitus), heart disease, heart failure, HIV, hypertension (high blood pressure), immune deficiency, immunocompromised state from solid organ transplant, liver disease, lung disease, neurologic conditions, obesity, pregnancy, pulmonary fibrosis, sickle cell disease, smoking, thalassemia, use of corticosteroids, use of immune weakening medicines, and combinations thereof.

C. Immunization Doses, Schedules and Regimens

In some embodiments, a recombinant VSV vector, recombinant VSV particle, immunogenic recombinant protein, or SARS-CoV-2 vaccine is provided in an effective amount for inducing an immune response in a subject wherein at least one dose is administered. In some embodiments, a vaccine comprises a recombinant VSV vector, recombinant VSV particle, or immunogenic recombinant protein in an effective amount for inducing an immune response against the SARS-CoV-2 S protein in a subject wherein at least one dose is administered.

As used herein, the term "dose" means a quantity (of, for example, a VSV vector, recombinant VSV particle, immunogenic recombinant protein, or SARS-CoV-2 vaccine) taken or recommended to be taken at a particular time. As used herein, the term "single dose" refers requiring only one administration to induce an immune response. As used herein, the term "multiple doses" refers requiring more than one dose to induce an immune response. In some embodiments, the dose or doses provide protection from disease. Suitable doses may be selected based on studies on safety, tolerability, immunogenicity, animal challenge, dose-response, and/or literature-based modeling.

While dose can vary depending on the route of administration and the size of the subject, suitable doses can be determined by those of skill in the art, for example, by measuring the immune response of a subject, such as a laboratory animal, using conventional immunological techniques, and adjusting the dosages as appropriate. Such techniques for measuring the immune response of the subject include but are not limited to, chromium release assays, tetramer binding assays, IFN-γ ELISPOT assays, IL-2 ELISPOT assays, intracellular cytokine assays, and other immunological detection assays, e.g., as detailed in the text "Antibodies: A Laboratory Manual" by Ed Harlow and David Lane.

In some embodiments, a dose may comprise an effective amount in the range of $1 \times 10^3$ to $1 \times 10^9$ plaque forming units as measured by standard methods. One example of an effective amount could include approximately $1 \times 10^4$, $1 \times 10^5$, $1 \times 10^6$, $1 \times 10^7$, or $1 \times 10^8$ plaque-forming units.

In some embodiments, dose levels for a recombinant VSV vector, recombinant VSV particle, immunogenic recombinant protein, or SARS-CoV-2 vaccine may range from $1.0 \times 10^6$ to $3.8 \times 10^8$ plaque forming units. In some embodiments, a lowest dose level for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) is $1.0 \times 10^6$. In some embodiments, a lower middle dose level for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) is $3.8 \times 10^6$. In some embodiments, an upper middle dose level for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) is $1.5 \times 10^7$. In some embodiments, a higher dose level for a recombinant VSV vector, recombinant VSV particle, immunogenic recombinant protein, or SARS-CoV-2 vaccine (which may comprise rVSVΔG-SARS-CoV-2 clone MB1) is $5.6 \times 10^7$. In some embodiments, a highest dose level for a recombinant VSV vector, recombinant VSV particle, immunogenic recombinant protein, or SARS-CoV-2 vaccine (which may comprise rVSVΔG-SARS-CoV-2 clone MB1) is $3.8 \times 10^8$.

In some embodiments, dose levels for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) may range from $1.0 \times 10^6$ to $3.8 \times 10^8$, from $1.0 \times 10^6$ to $5.0 \times 10^7$, or from $2.0 \times 10^6$ to $2.0 \times 10^7$ plaque forming units.

In some embodiments, dose levels for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) may range from $1.0 \times 10^6$ to $3.8 \times 10^6$ plaque forming units. In some embodiments, dose levels for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) may range from $3.8 \times 10^6$ to $1.5 \times 10^7$ plaque forming units. In some embodiments, dose levels for a recombinant VSV vector, recombinant VSV particle, immunogenic recombinant protein, or SARS-CoV-2 vaccine (which may comprise rVSVΔG-SARS-CoV-2 clone MB1 or rVSVΔG-SARS-CoV-2 clone MB2) may range from $1.5 \times 10^7$ to $5.6 \times 10^7$ plaque forming units. In some embodiments, dose levels for a recombinant VSV vector, recombinant VSV particle, immunogenic recombinant protein, or SARS-CoV-2 vaccine (which may comprise rVSVΔG-SARS-CoV-2 clone MB1) may range from $5.6 \times 10^7$ to $3.8 \times 10^8$ plaque forming units.

In some embodiments, a dose level for a recombinant VSV vector, recombinant VSV particle, immunogenic recombinant protein, or SARS-CoV-2 vaccine is chosen from $5.0 \times 10^5$, $2.4 \times 10^6$, $1.15 \times 10^7$, and $5.55 \times 10^7$ plaque forming units.

The recombinant VSV vector, recombinant VSV particle, immunogenic recombinant protein, or SARS-CoV-2 vaccine may be administered in a single dose, in two doses, or in multiple doses. The immunization regimes may comprise 1 to 6 doses, but may have as few as one or 2 or 4. Two or multiple doses may be administered sequentially with days, weeks, months or years apart. In some embodiments, a set time interval between doses may range from 10 days to several weeks, and may be 2, 4, 6 or 8 weeks. For example, two doses may be administered at approximately 1, 2, 3, 4 weeks, 1, 2, 3, 4, 5, 6, 7, 8, 9, 10, 11 or 12 months, 1, 2, 3, 4, 5, 6, 7, 8, 9 or 10 years apart. For humans, the interval is typically from 2 to 6 weeks.

The first dose may be for a priming immunization and the second dose or follow-up dose(s) may be a boosting immunization. Each dose shall have an effective amount of the VSV vector, recombinant VSV particle, immunogenic recombinant protein, or SARS-CoV-2 vaccine as described herein.

Immunizations can also include administration of an adjuvant with the VSV vector, recombinant VSV particle, immunogenic recombinant protein, or SARS-CoV-2 vaccine. In some embodiments, the methods comprise annual, biannual or other long interval (e.g., 5-10 years) booster immunizations which serve to supplement the initial immunization protocol.

Immunizations may include a variety of prime-boost regimens, for example, DNA prime-Adenovirus boost regimens. In many embodiments, one or more priming immunizations are followed by one or more boosting immunizations. The vaccine or pharmaceutical composition can be the same or different for each immunization and the type of immunogenic composition (e.g., containing recombinant VSV vector, recombinant VSV particle, immunogenic recombinant protein, or SARS-CoV-2 vaccine), the route, and formulation of the immunogens can also be varied. For example, if an expression vector is used for the priming and boosting steps, it can either be of the same or different type (e.g., DNA or bacterial or viral expression vector). One useful prime-boost regimen provides for two priming immunizations, four weeks apart, followed by two boosting immunizations at 4 and 8 weeks after the last priming immunization. It should also be readily apparent to one of skill in the art that there are several permutations and combinations that are encompassed using the DNA, bacterial and viral expression vectors of the disclosure to provide priming and boosting regimens.

In some embodiments, at least one priming dose is administered and at least one boosting dose is administered, wherein the doses can be the same or different, provided that at least one of the doses comprises recombinant VSV vector, recombinant VSV particle, immunogenic recombinant protein, or SARS-CoV-2 vaccine, and wherein a sufficient amount was administered in each dose to induce a SARS-CoV-2-specific immune response in the subject. The SARS-CoV-2-specific immune response can include a SARS-CoV-2-specific T-cell immune response or a SARS-CoV-2-specific B-cell immune response. In some embodiments, the immunizations can be done at intervals, such as at least 0-29 or more weeks.

In instances where at least a portion of the VSV-G protein is retained, the prime-boost regimen can also include VSV vectors that derive their G protein from different serotype vesicular stomatitis viruses (Rose N F, Roberts A, Buonocore L, Rose J K. Glycoprotein exchange vectors based on vesicular stomatitis virus allow effective boosting and generation of neutralizing antibodies to a primary isolate of human immunodeficiency virus type 1. J Virol. 2000 December; 74(23):10903-10). The VSV vectors used in these examples contain a G protein derived from the Indiana serotype of VSV. Vectors can also be constructed to express epitopes in the context of G molecules derived from other VSV serotypes (i.e. vesicular stomatitis New Jersey virus or vesicular stomatitis Alagoas virus) or other vesiculoviruses (i.e. Chandipura virus, Cocal virus, Isfahan virus).

The recombinant VSV vector, recombinant VSV particle, immunogenic recombinant protein, or SARS-CoV-2 vaccine can be administered alone, or can be co-administered, or sequentially administered, with other SARS-CoV-2 immunogens and/or SARS-CoV-2 immunogenic compositions, e.g., with "other" immunogenic, antigenic or vaccine or therapeutic compositions thereby providing multivalent or "cocktail" or combination compositions of the disclosure and methods of employing them. Again, the ingredients and manner (sequential or co-administration) of administration, as well as dosages can be determined taking into consideration such factors as the age, sex, weight, species and condition of the particular subject, and the route of administration.

EXAMPLES

Example 1. VSVΔG-SARS-CoV-2 Genomic Clones

VSVΔG-SARS-CoV-2 (also referred to as rVSVΔG-SARS-CoV-2) genomic clones have been generated by replacing VSV-G gene in VSV with a nucleotide sequence encoding wild-type SARS-CoV-2 S protein or a variation thereof. The resulting VSVΔG-SARS-CoV-2 chimeric viruses exhibited substantially diminished replicative capacity. To obtain replication-competent VSVΔG-SARS-CoV-2 chimeric viruses, adaptive mutants having rescued replicative capacity were obtained by infecting cells with the VSVΔG-SARS-CoV-2 chimeric viruses. The replication-competent VSVΔG-SARS-CoV-2 clone isolates have been found to contain novel mutations in the SARS-CoV-2 S protein and used to select two vaccine candidates: rVSVΔG-SARS-CoV-2 clones MB1 and MB2.

A gene encoding a wild-type SARS-CoV-2 S protein or a variant thereof was cloned into the rVSV genetic background as described by Lawson et al. (PNAS 92, 4477-4481 (1995)) used for development of the rVSVΔG-ZEBOV-GP chimera as described by Garbutt et al. (J Virol 78, 5458-5465 (2004)) and Jones et al. (Nature medicine 11, 786-790 (2005)) (FIG. 4).

The nucleotide sequence for the SARS-CoV-2 S protein, wild-type or a variant thereof (FIG. 5), was synthesized at GenScript, Inc. and cloned into a VSV genomic plasmid in the position normally occupied by the VSV-G gene. The nucleotide sequences of the resulting VSVΔG-SARS-CoV-2 genomic clones were confirmed prior to their use for virus rescue.

For example, the wild-type SARS-CoV-2 S protein sequence was from SARS-CoV-2 isolate USA-WA1/2020 (accession number MN985325). The resulting VSVΔG-SARS-CoV-2 genomic clone, Construct 1 with wild-type S protein, was successfully used in cell culture to rescue replication-competent rVSVΔG-SARS-CoV-2 having adaptive mutations in the SARS-CoV-2 S protein.

Example 2. Cell Culture

Vero cells (WHO 10-87) were used to cultivate VSVΔG-SARS-CoV-2 vectors as described in this application. The Vero Working Cell Bank (WCB Lot 117-10004) was produced under GMP conditions at our manufacturer, SAFC Pharma (Carlsbad, CA).

Vero cells generated from the WCB were cultured in DMEM (#12430-047) supplemented with 10% heat-inactivated Fetal bovine serum (SAFC #12103C) plus 2 mM L-glutamine, 1 mM sodium pyruvate, and 0.1 mM MEM nonessential amino acids (all obtained from Thermo Fisher unless specified). The cells were maintained in incubators at 37° C., 5% $CO_2$ and 85% Humidity.

The cell density at the time of infection was 1.20E+07 viable cells in T175 flask.

Figure 6:
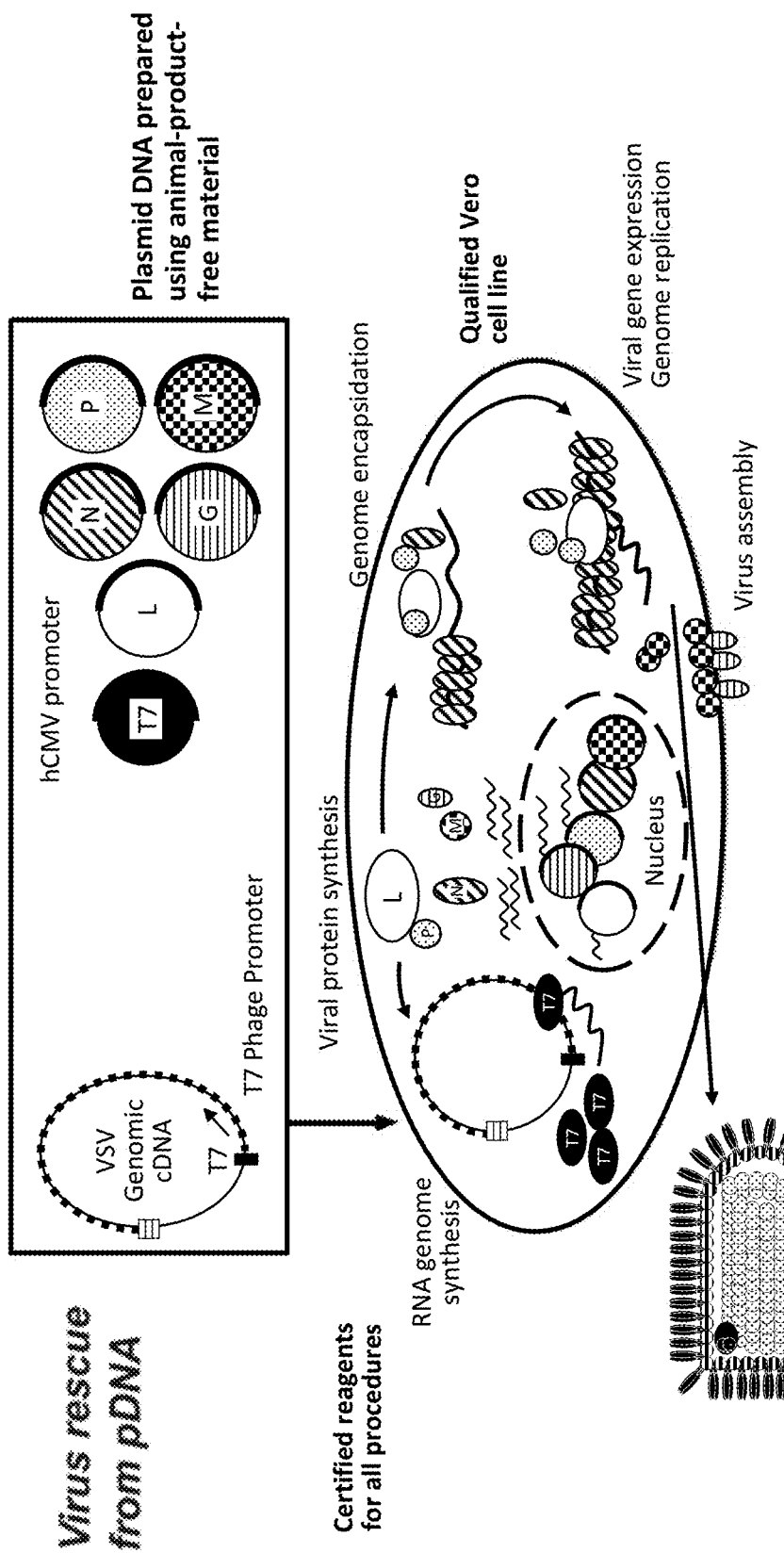
FIG. 6 illustrates recombinant VSVΔG-SARS-CoV-2 rescue from plasmid DNA. To initiate recovery of infectious virus from plasmid DNA, a blend of seven plasmids (contained in the box at the top of the figure) is electroporated into Vero cells that have been qualified for vaccine production. Witko et al., An efficient helper-virus free method for rescue of recombinant paramyxoviruses and rhadoviruses from a cell line suitable for vaccine development, J. Virol. Methods (2006); doi:10.1016/j.jviromet.2006.02.006. One of the plasmids is the VSVΔG-SARS-CoV-2 genomic clone that can be transcribed by the phage T7 RNA polymerase to generate viral RNA genomes. The remaining 6 supporting plasmids are controlled by the human cytomegalovirus (hCMV) promoter that is recognized by cellular RNA polymerase II in the nucleus. These supporting plasmids are designed to express proteins needed to initiate the virus life cycle, including the T7 bacteriophage RNA polymerase and the five VSV structural proteins (VSV-N, nucleocapsid protein; VSV-P, phosphoprotein; VSV-M, matrix protein; VSV-G, glycoprotein; and VSV-L, or large protein, which is the catalytic subunit of the viral RNA-dependent RNA polymerase; Dietzgen et al., The family Rhabdoviridae: mono- and bipartite negative-sense RNA viruses with diverse genome organization and common evolutionary origins, Virus Res. (2017); doi:10.1016/j.viruses.2016.10.010). Following electroporation, the cells are cultured for approximately 72 hours during which time the plasmids are transcribed, viral proteins are synthesized and viral genomes are encapsidated with VSV-N to form a nucleocapsid. The nucleocapsid can then be transcribed and replicated by the viral RNA polymerase allowing initiation of virus replication and assembly and release of infectious progeny virions that can be used later to infect fresh cultures of cells.

Example 3. Virus Rescue rVSVΔG-SARS-CoV-2 rescue was conducted using Vero cells as illustrated in FIG. 6. In brief, Vero cells were electroporated with one of the rVSVΔG-SARS-CoV-2 genomic clones plus a blend of six 'supporting' plasmids that express the five VSV structural proteins needed to initiate the virus replication cycle [nucleoprotein (N); phosphoprotein (P); matrix (M); glycoprotein (G); large protein (L) or viral RNA-dependent RNA polymerase] as well as bacteriophage T7 RNA polymerase (Witko et al., J Virol Methods 135, 91-101 (2006); Rabinovich et al., PLoS ONE 9, e106597 (2014)). Conditions for electroporation with BTX830 apparatus was described by Rabinovich et al. (PLoS ONE 9, e106597 (2014)).

After electroporation, the cells were plated in the medium of 10% FBS to rest in the incubator at 37° C. with 5% $CO_2$, 85% Humidity for two hours after which the cultures were subjected to heat shock at 42° C., 5% $CO_2$ and 85% Humidity for another 2 hours. Following the heat shock, the cells were incubated for three days at 37° C. with 5% $CO_2$, 85% humidity.

Figure 7:
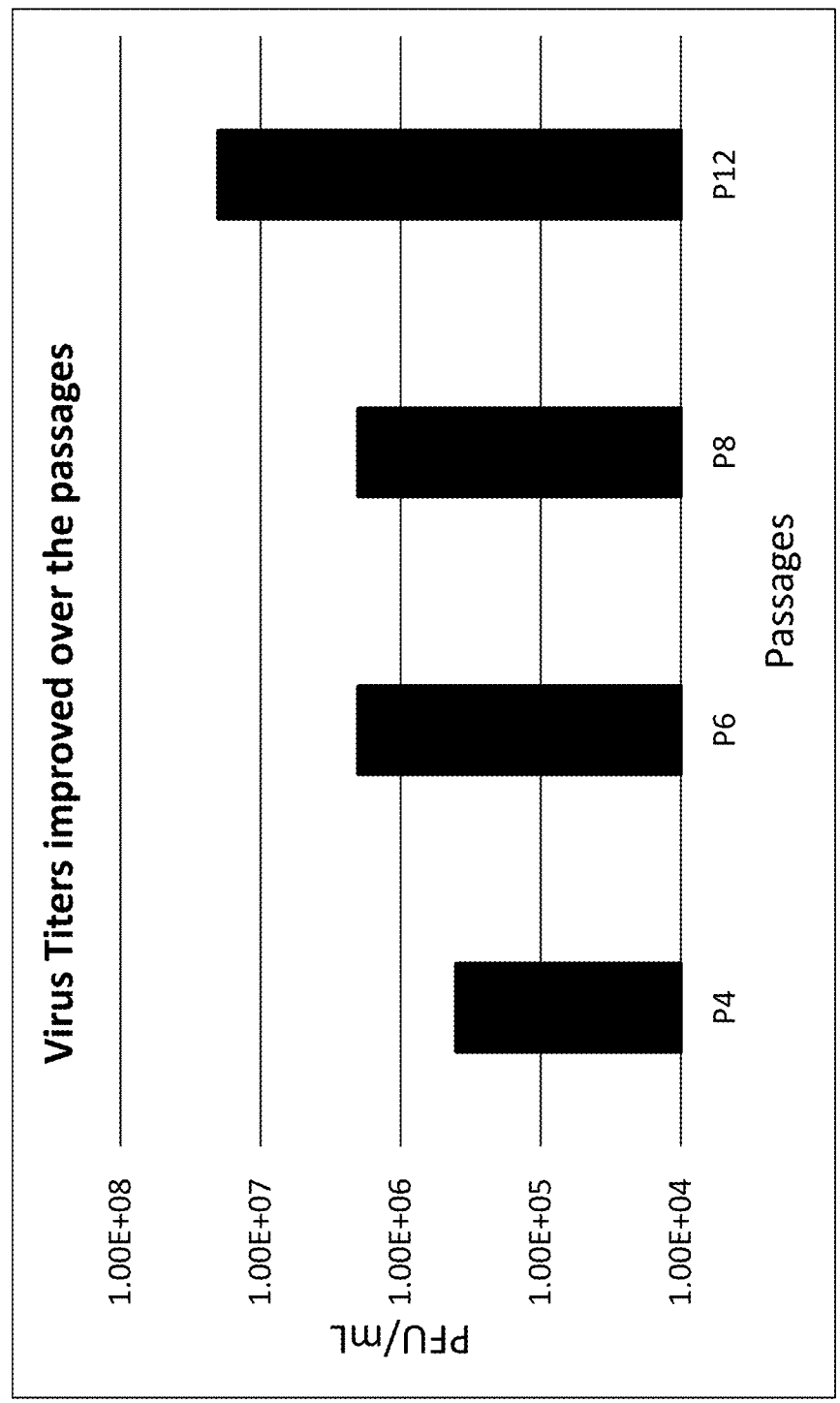
FIG. 7 shows virus infectivity titers of Construct 1 (rescued using a plasmid encoding wild-type SARS-CoV-2 S protein) improved over passages. Construct 1 (wild-type SARS-CoV-2 S protein) is adapted to the Vero cell culture by serial passages. Titers improved from 4.00E+05 pfu/mL to 2.00E+07 pfu/mL.
Figure 8B:
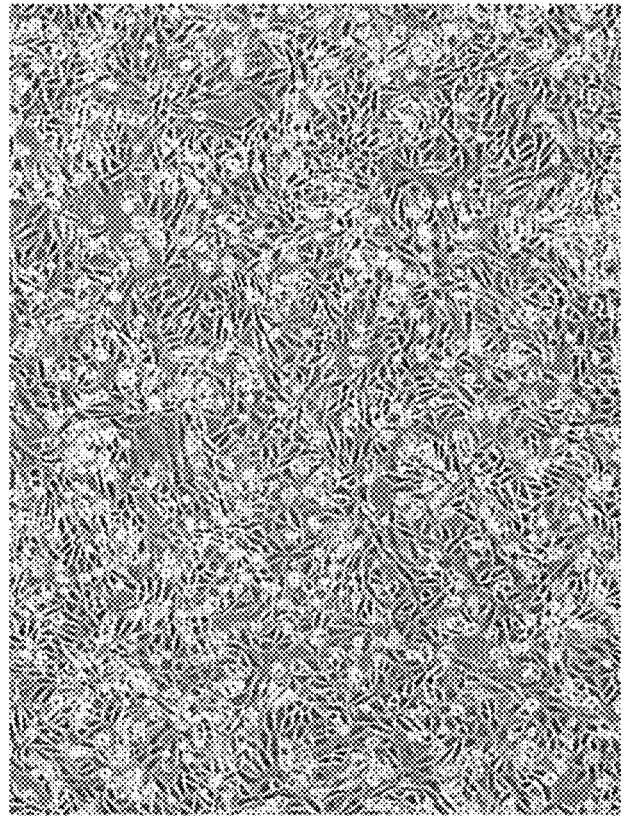
FIGS. 8A-B show Vero cells infected by Construct 1 (wild-type SARS-CoV-2 S protein with adaptive mutations evolving over multiple passages): passage 4 (P4) 52 hours post infection (FIG. 8A) and passage 12 (P12) 24 hours post infection (FIG. 8B). After serial passage, Construct 1 (wild-type SARS-CoV-2 S protein) was adapted to the Vero cell culture. At P12, more lytic cytopathic effect replaced the earlier syncytia at P4. The infection progressed more rapidly at the higher passages.
Figure 8A:
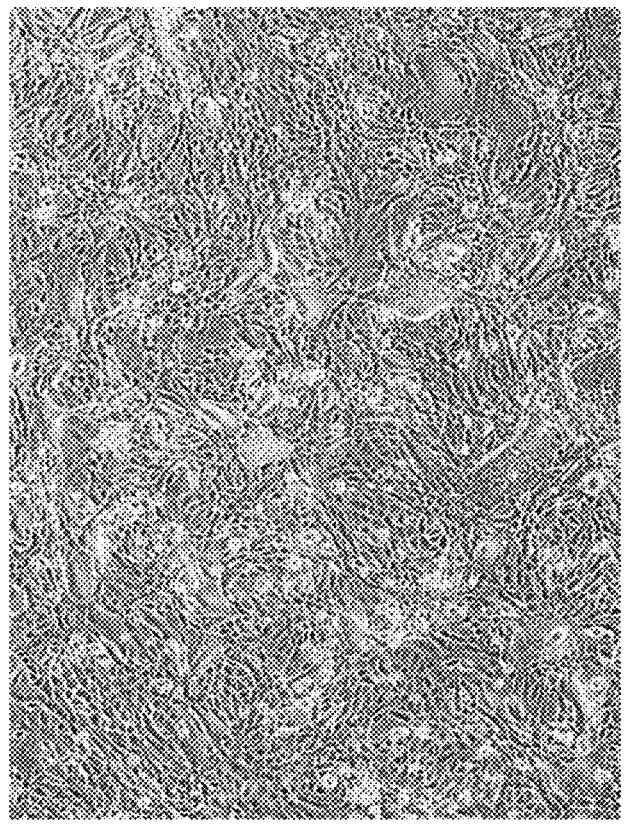
Figure 9:
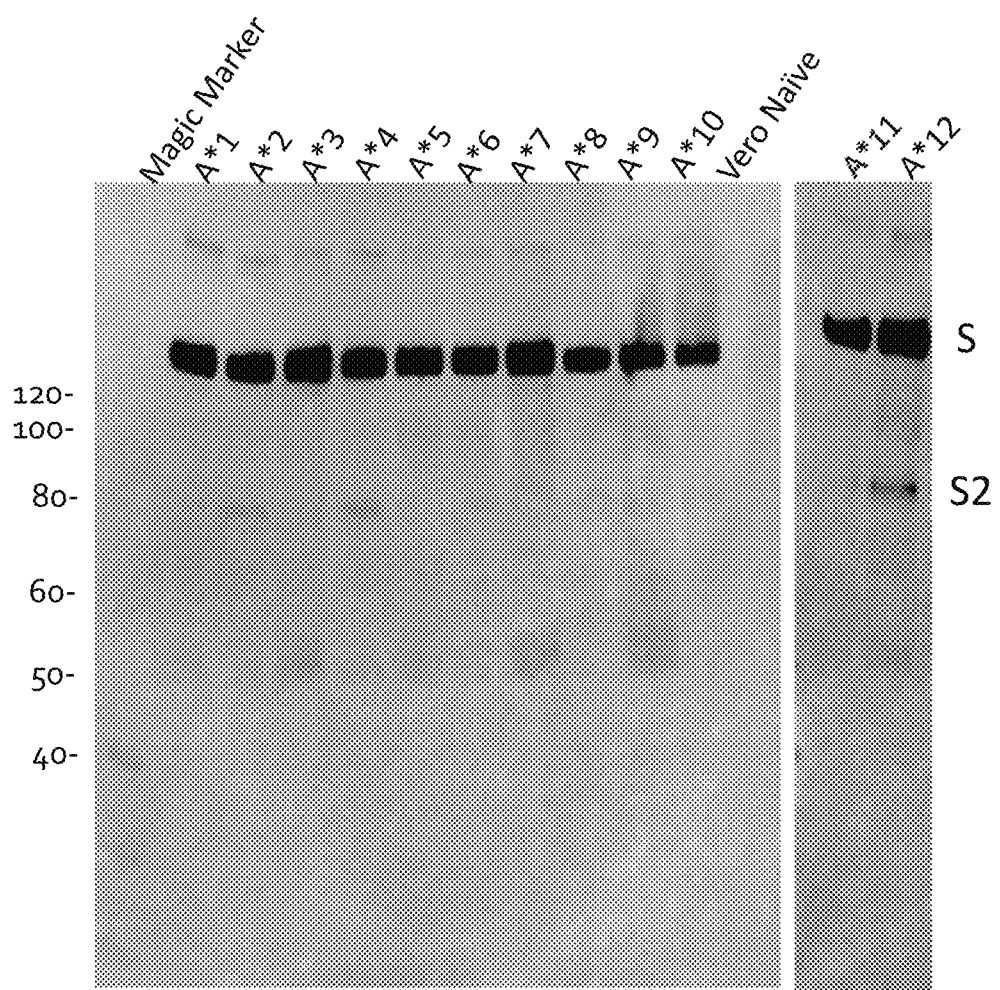
FIG. 9 shows SARS-CoV 2 S protein detected in the infected Vero cell lysate by Western blot. Vero cells were infected by clone isolates A*1 to A*12. Clone isolates with reduction of cleaved S protein had mutations at the Furin cleavage site, for example, R682K, R685G, S813R or S813F. Full length SARS-CoV-2 S protein (S) and S2 subunit (S2) are shown.
Figure 14B:
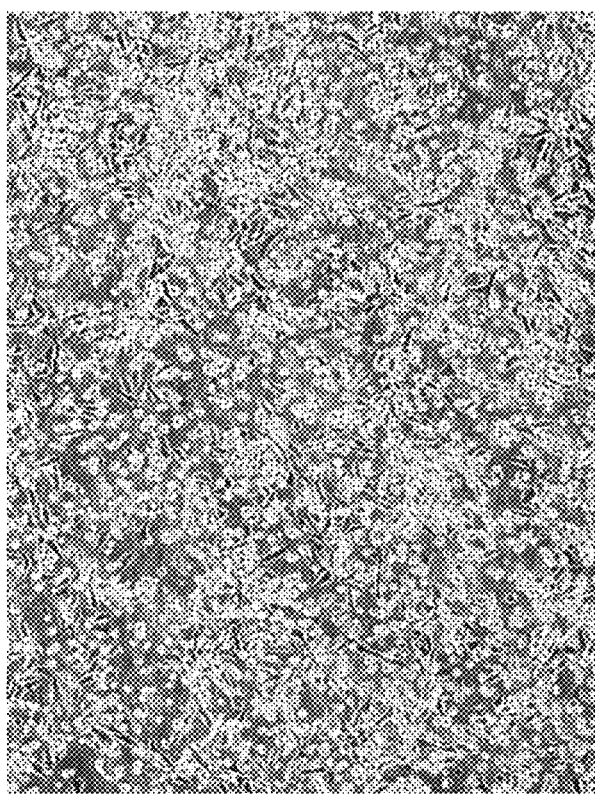
FIGS. 14A-B shows Vero cells infected by Construct 6.
Figure 14A:
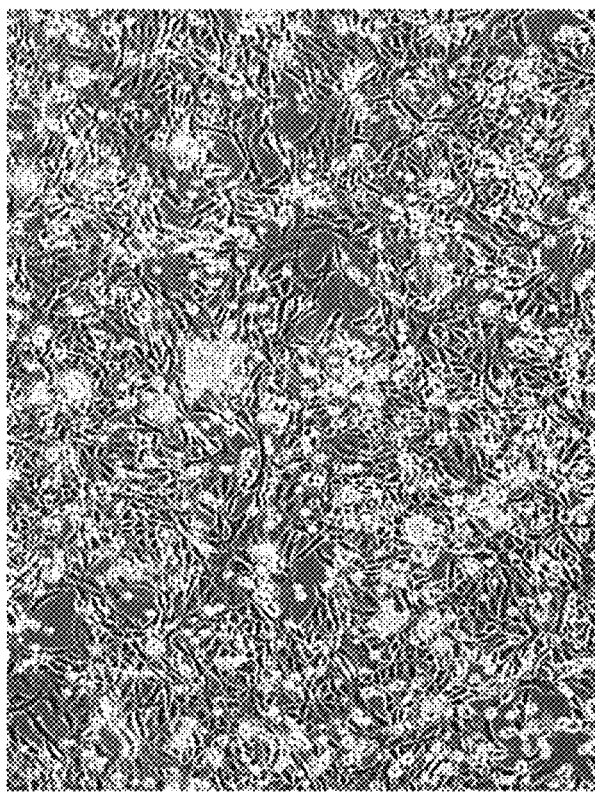
Figure 15:
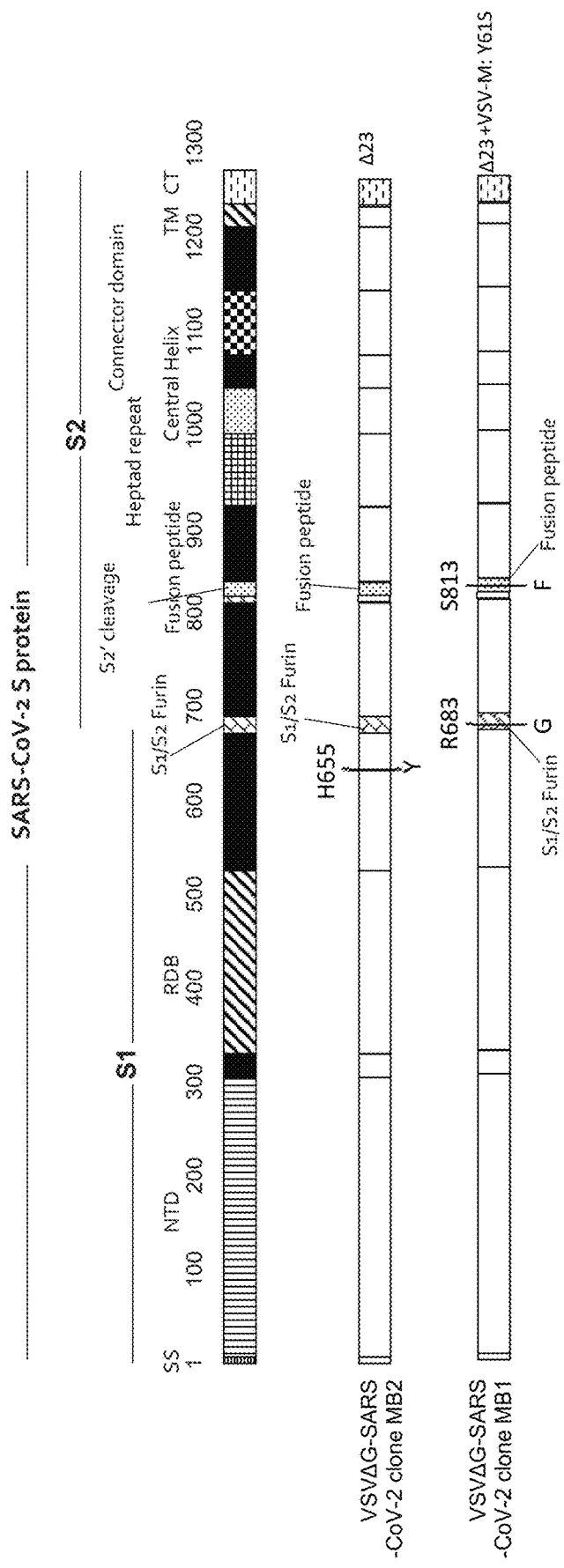
FIG. 15 shows the domains, mutations, and cleavage sites of SARS-CoV-2 S protein. MB1 and MB2 variants of the rVSVΔG-SARS-CoV-2 S protein are also shown.

Example 4. Serial Passages in Vero Cells to Derive a Recombinant Virus that Propagates to Higher Titers Rescue of rVSVΔG-SARS-CoV-2 virus is challenging because growth of a virus expressing an exogenous S protein is substantially attenuated. To overcome this barrier, supernatant collected from a rescue flask containing the rVSVΔG-SARS-CoV-2 virus was passaged one time on the Vero cells transiently expressing VSV-G to enhance the initial growth of recombinant virus. Following this first round of virus amplification, the recombinant virus was passaged additional times in Vero cell monolayers without providing VSV-G complementation. As mentioned above, adaptation by serial passage allows isolation of a genetically stable virus with improved growth characteristics (FIGS. 7, 8 and 14).

Vero cell propagation and infection were conducted using growth medium containing 10% FBS. Following the additional serial passages described above, virus harvest in the medium was used for clonal isolation by plaque purification. All samples are characterized by assays listed on Table 2.

TABLE 2

| | Characterization Assays |
|---|---|
| 1 | Infectivity titer on Vero cells by plaque assay |
| 2 | Whole genome sequence determined by Sanger Sequencing |
| 3 | S glycoprotein expression by Western blot |
| 4 | Modeling of sequence variants on SARS-CoV-2 S protein structure |
| 5 | SARS-CoV-2 pseudoneutralization (PRNT) assay |
| 6 | hACE2-human cell line infectivity assay |
| 7 | Ig-ACE2 flow virometry |

Example 5. Plaque Purification and Characterization

Plaque purification was executed by picking multiple well-isolated plaques after which each plaque was amplified in T-25 flasks to generate virus stocks. Each plaque isolate was then analyzed by the characterization assays described in Table 2.

Plaque isolation was performed using two related procedures. In the first procedure, plaques were picked from monolayers cultured in growth medium supplemented with FBS after which the virus was amplified in the presence of serum. In the second procedure, the Vero cell monolayer was cultured in serum-free medium (VP-SFM). rVSVΔG-SARS-CoV-2 clone MB1 (nucleic acid sequence SEQ ID NO: 150 or amino acid sequences SEQ ID NOS: 151-153, 155, and 156) is a virus clone isolated using VP-SFM. rVSVΔG-SARS-CoV-2 clone MB2 (nucleic acid sequence SEQ ID NO: 154 or amino acid sequences SEQ ID NOS: 152, 155-158) is a virus clone prepared using medium supplemented with FBS (described in Example 7 below).

Figure 12:
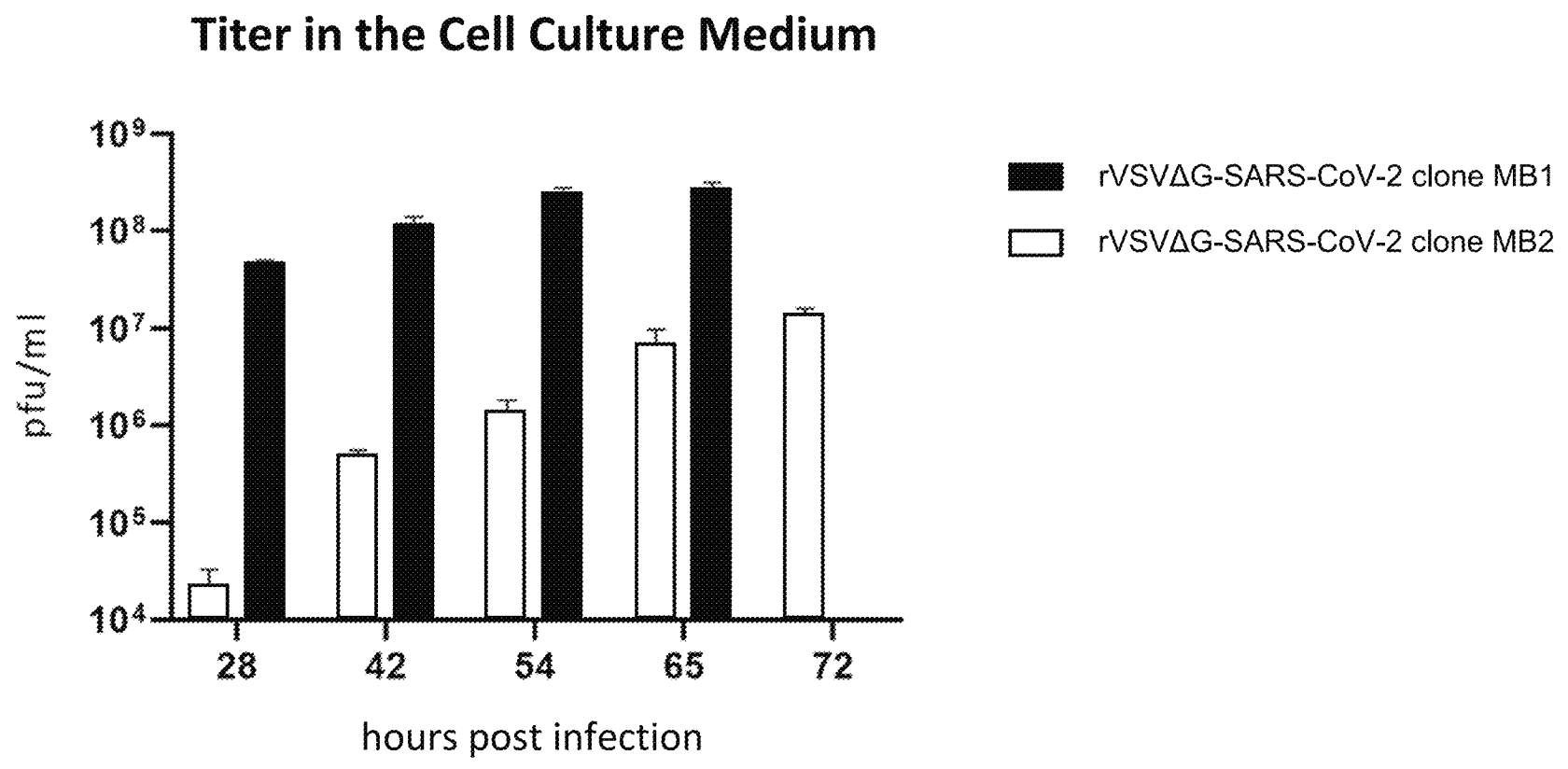
Figure 13B:
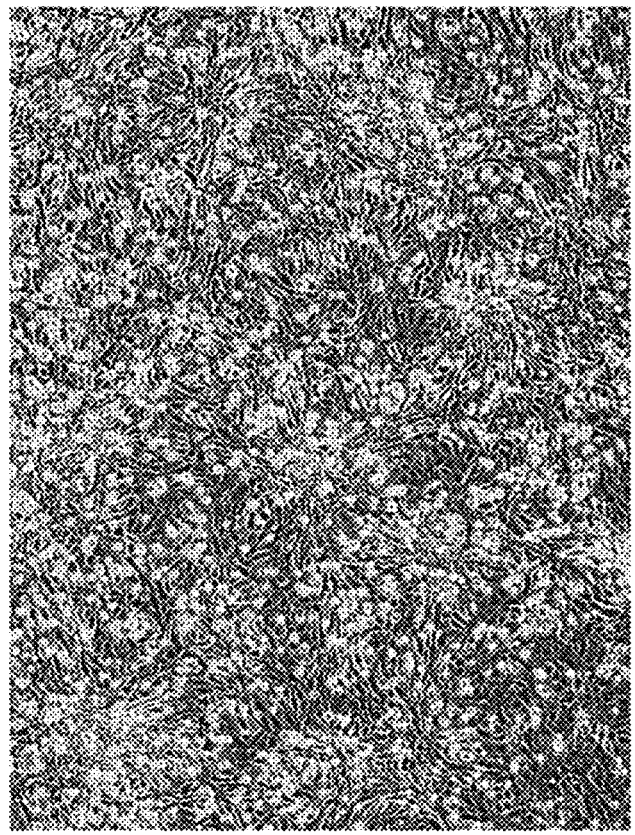
FIGS. 13A-B shows cytopathic effect on Vero cells at the time of harvest of rVSVΔG-SARS-CoV-2 clone MB1 (FIG. 13A) and rVSVΔG-SARS-CoV-2 clone MB2 (FIG. 13B).
Figure 13A:
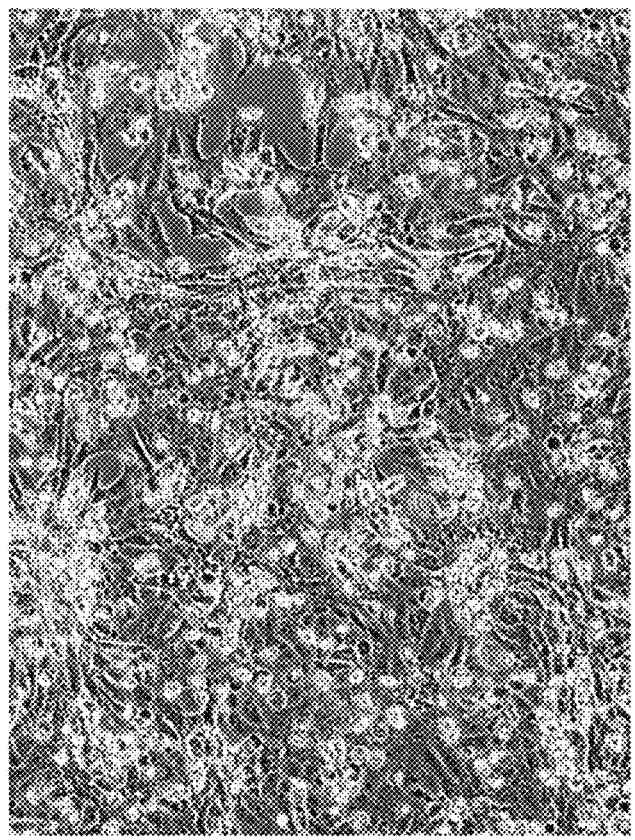

Example 6. Amplification of rVSVΔG-SARS-CoV-2 Clones MB1 and MB2 to Generate Two Leading Vaccine Candidates Two clone isolates, rVSVΔG-SARS-CoV-2 clone MB1 (nucleic acid SEQ ID NO: 150 or amino acid sequences SEQ ID NOS: 151-153, 155, and 156) and rVSVΔG-SARS-CoV-2 clone MB2 (nucleic acid SEQ ID NO: 154 or amino acid sequences SEQ ID NOS: 152 and 155-158), were selected as vaccine candidates. Expansion of these two clone isolates was conducted using Vero cells cultured in VP-SFM. Both pre-master virus seed (pre-MVS) vaccine candidates were passaged in Vero cells to ensure no further genomic changes occurred during subsequent processing. rVSVΔG-SARS-CoV-2 clone MB1 was passaged an additional five passages. rVSVΔG-SARS-CoV-2 clone MB2 was passaged an additional three passages. rVSVΔG-SARS-CoV-2 clone MB1 was prioritized for GMP manufacturing of the Master Virus Seed (MVS) (FIGS. 12 and 13A-B).

Example 7. Virus Infectivity Titers Measured by Plaque Assay

We set out to identify at least one clone that provided a high virus titer by testing over 44 clone isolates for infectivity. A higher titer will enable higher doses, which may enable better infectivity and a more robust immune response in a subject. Virus infectivity titers of clone isolates were measured over time after cell infection by a standard immunoplaque assay. The clones were isolated and grown at serum-containing medium or in serum-free medium. Pre-master seed viral stocks were generated for each clone. Vero cells were used to provide data that will support vaccine manufacturing. Ten-fold dilutions of the viral stock were prepared using 2% FBS as diluent and 0.5 mL of the serial dilution was inoculated on the Vero cell monolayer in each well of 6-well plate. After one-hour incubation, the inoculums were removed, and the Vero cells were overlayed with 0.8% Agarose plus 2% FBS. Plaques became visible from 24 to 72 hours post infection. Cells were then fixed with 7% formaldehyde adding on top of the agarose for 30 minutes. After the cells were fixed, the agarose overlays were removed to allow the monolayer to be stained by Crystal violet. The infectivity titers were expressed as plaque-forming units per ml (PFU/mL) and calculated by the average of at least two replicates. Using this first method, we measured infectivity over time for Construct 1 (rescued using a plasmid encoding the wild-type S protein); infectivity titers improved from 4.00E+05 pfu/mL to 2.00E+07 PFU/mL with increasing rounds of passaging (FIG. 7).

A second method was also used to measure infectivity titers. Vero cells were plated, incubated at 37±1° C. and 5±1% $CO_2$, and later checked for confluency. A dilution box was prepared as shown in Table 3. Samples were thawed at ambient temperature in a Biosafety Cabinet and the positive control was thawed at 37±1° C. in a water bath. Samples and the positive control were diluted according to Table 3.

TABLE 3

Dilution Box Set-Up for Drug Substance and PC Sample

| Dilutions | Dilution Scheme |
|---|---|
| $1^{st}$ Dilution | 1:10-900 μL dilution medium + 100 μL sample |
| $2^{nd}$ Dilution | 1:100-900 μL dilution medium + 100 μL previous dilution (10) |
| $3^{rd}$ Dilution | 1:4000-975 μL dilution medium + 25 μL previous dilution (100) |
| $4^{th}$ Dilution | 1:8000-500 μL dilution medium + 500 μL previous dilution (4K) |
| $5^{th}$ Dilution | 1:16000-500 μL dilution medium + 500 μL previous dilution (8K) |
| $6^{th}$ Dilution | 1:32000-500 μL dilution medium + 500 μL previous dilution (16K) |

Plates of Vero cells were removed from the 37±1° C., 5+1% $CO_2$ incubator for media removal. Media was removed by gentle decanting. We used an absorbent mat to remove residual media by gently bringing the mat in contact with the plate. To avoid drying the monolayer of Vero cells, the plates of cells were decanted only one at a time. Each well of cells was inoculated with 150 μL of each dilution in the plate. Each plate was rocked ensure that each inoculum covered the entire well. Plates were placed back into the 37±1° C., 5±1% $CO_2$ incubator for approximately 1 hour to allow for attachment. In instances where the number of plates being assayed is very large, the plates were assayed in batches. During the attachment time period, plates were rocked manually at 30±5 minute intervals to ensure even distribution of the samples in the wells and to prevent the cells from drying out.

After the 1 hour attachment time period, the plates were removed from the incubator and 1 mL of overlay was added to each well. Plates were handled very gently and with caution to avoid disturbing the monolayer of Vero cells, such as touching pipet tips of the multichannel pipet to the side of each well while pipetting so as to avoid unnecessary turbulence. The plates were left to cool in the Biosafety Cabinet for 15 to 30 minutes or until the overlay had firmed. After that, the plates were placed back in the incubator for 24±1 hours until staining.

For staining, plates were removed from the incubator and 200 μL of formalin was added to each well. The cells were incubated with formalin at room temperature for 60±10 minutes. The wells were decanted by gently inverting the plates and tapping to remove plugs. 200 μL of 1% crystal violet solution was applied to each well. After 3 to 5 minutes, the plates were submerged in water for rinsing. The plates were submerged three times or more times, until we observed no more stain coming off in the rinse. The plates were then placed on absorbent pads and left to dry at ambient temperature. The plaques were then counted to determine titer. The titer for each clone is shown in Table 4.

TABLE 4

Titers from Immunoplaque (Infectivity) Assay

| Source | Clone | Geomean Infectious Titer |
|---|---|---|
| Round 1 | 1 | 1.6E+06 |
| | 2 | 1.5E+06 |
| | 3 | 1.6E+06 |
| | 4 | 1.9E+06 |
| | 5 | 2.0E+06 |
| | 6 | 2.1E+06 |
| | 7 | 1.5E+06 |
| | 8 | 1.9E+06 |
| | 9 | 2.1E+06 |
| | 10 | 2.3E+06 |
| | 11 | 2.1E+06 |
| | 12 | 1.9E+06 |
| | 13 | 2.4E+06 |
| | 14 | 2.4E+06 |
| | 15 | 2.0E+06 |
| | 16 | 1.3E+06 |
| | 17 | 2.2E+06 |
| | 18 | 2.1E+06 |
| | 19 | 2.0E+06 |
| | 20 | 1.7E+06 |
| Plaque isolates from serum-containing medium | SC1 | 4.5E+05 |
| | SC3 | 4.3E+05 |
| | SC7 | 2.7E+05 |
| | MB2 | 1.6E+05 |
| Plaque isolates from serum-free medium | SF1 | 7.4E+04 |
| | SF2 | 3.24E+03 |
| | SF3 | 4.95E+05 |
| | SF4 | 1.95E+03 |
| | SF5 | 3.25E+04 |
| | SF6 | 9.97E+04 |
| | SF7 | 5.80E+04 |

TABLE 4-continued

Titers from Immunoplaque (Infectivity) Assay

| Source | Clone | Geomean Infectious Titer |
|---|---|---|
| | SF8 | 6.99E+03 |
| | SF9 | 1.4E+04 |
| | SF10 | 2.85E+04 |
| | SF11 | 1.05E+06 |
| | SF12 | 3.91E+05 |
| | SF13 | 3.58E+05 |
| | SF14 | 1.42E+05 |
| | SF15 | 1.26E+05 |
| | SF16 | 1.51E+05 |
| | SF17 | 9.62E+03 |
| | SF18 | 8.51E+04 |
| | SF19 | 5.51E+04 |
| | MB1 | 1.80E+06 |

Figure 11:
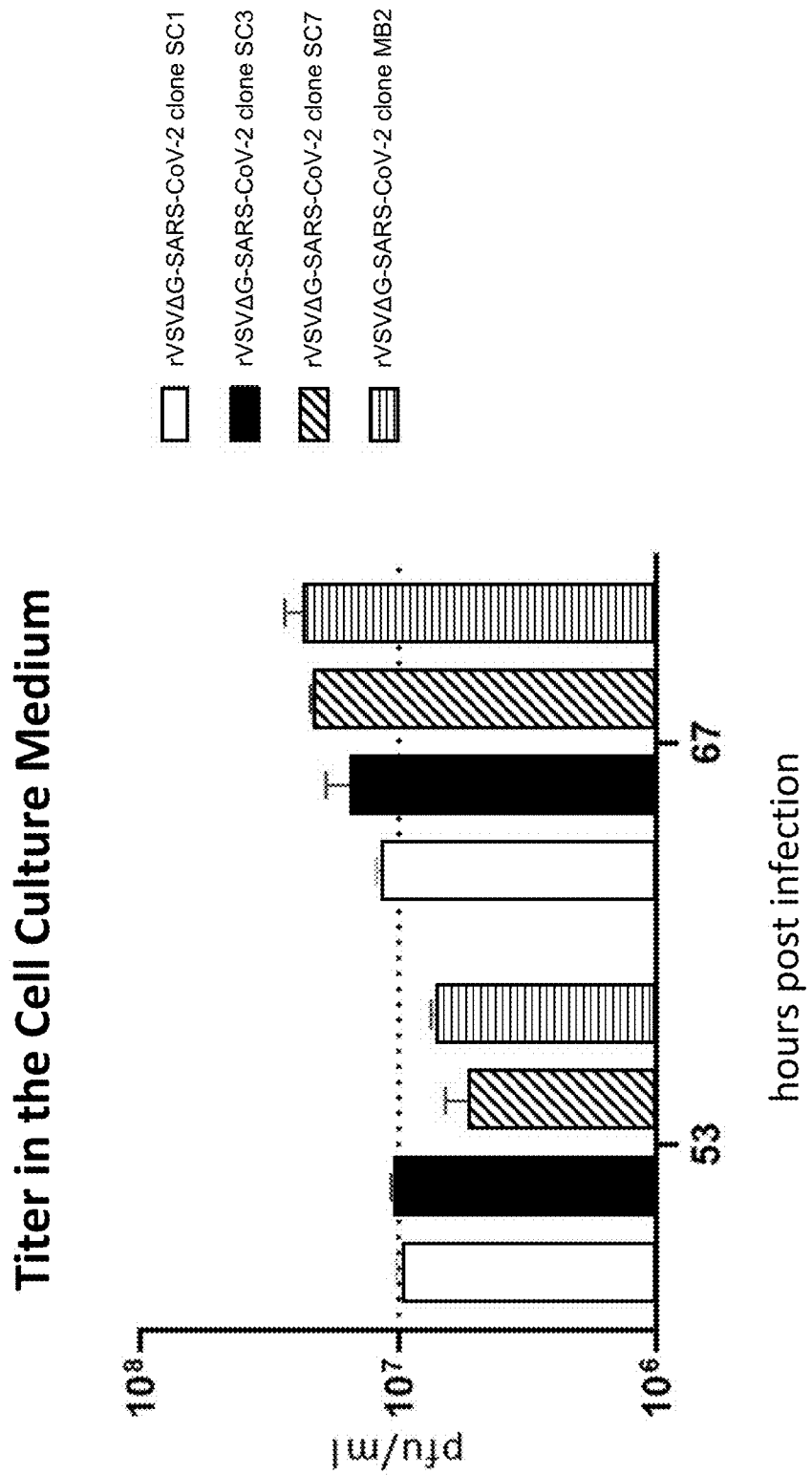
FIG. 11 shows titers of is rVSVΔG-SARS-CoV-2 clones SC1, SC3, SC7, and MB2 that were amplified in serum-free medium (VP-SFM). Titers of each clone were measured at indicating time points.

We then measured infectivity over time for clones SC1, SC3, SC7, and MB2 from the serum-containing medium and clone MB1 from the serum-free medium. PFU/mL for clones SC1, SC3, SC7, and MB2 at 53 and 67 hours are shown in FIG. 11. PFU/mL for clones MB1 and MB2 at 28, 42, 54, 65, and 72 hours are shown in FIG. 12. All five clones also showed improved infectivity titers over time (FIGS. 11 and 12).

Example 8. Whole Genome Sequencing

A. Materials and Methods

We set out to determine the purity and stability of each clone, which included determining that there were no changes to attenuating mutations in VSV. The whole genome of virus clone isolates were sequenced.

The Sanger sequencing method was used to determine the nucleotide sequences of the clone isolates. Viral RNA of each clone isolate was isolated by RNA extraction kit from Qiagen (#52906). One-step RT-PCR (SuperScript III) reactions were conducted to reverse transcribe and amplify the cDNAs cross the VSV genome. Eight overlapping cDNA fragments were generated to cover the 14 kb RNA genome. Each cDNA was 2 to 3 kb in length for further Sanger sequencing. Data was analyzed using DNASTAR SeqMan Pro, MegAlign, Vector NTi and ABI Seq Scanner2. Table 5 lists the primers used for sequencing the eight overlapping cDNA fragments in RT-PCR reactions N, P, M, S1, S2, L1, L2 and L3. Table 6 lists the primers used for the Sanger sequencing of the whole genome of rVSVΔG-SARS-CoV-2 clone isolates.

TABLE 6

List of Primers Used for the Sanger Sequencing of the rVSVΔG-SARS-CoV-2 Genome

| Primer name | Sequence | SEQ ID NO: |
|---|---|---|
| 1gVSVLeader_f | ACGAAGACAAACAAACCATTATTATCATTAAAAGG | 68 |
| 2gVSV_400f | AGCAGGGGATACAATCGGAATA | 69 |
| 3gVSV_800f | CACCTCTGCAAAATAACCGGAA | 70 |
| 4gVSV_1200f | GCAGAGATGTGGTCGAATGGC | 71 |
| 5gVSV_1600f | TGAAGGCTTTATACAGGGGC | 72 |
| 6gVSV_200r | TGGTAGACATATCCTCTTAG | 73 |
| 7gVSV_400r | GCTGGTTCTGGAAGCATCCG | 74 |
| 8gVSV_800r | CTGGAAGCATCATTTGGACCATTT | 75 |
| 9gVSV_1200r | GCTCTTTTCGCATACTGCATCATA | 76 |
| 10gVSV_1600r | CCACTTCCTCATCTGCATAGTCAT | 77 |
| 11gVSV_1200f | GCAGAGATGTGGTCGAATGGC | 78 |
| 12gVSV_1600f | TGAAGGCTTTATACAGGGGC | 79 |
| 13gVSV_2000f | TCCATGACTTTCCAACCCAAGA | 80 |
| 14gVSV_2400f | CGAGATGGACACCTATGATCCGAA | 81 |
| 15gVSV_1200r | GCTCTTTTCGCATACTGCATCATA | 82 |
| 16gVSV_1600r | CCACTTCCTCATCTGCATAGTCAT | 83 |
| 17gVSV_2000r | CTCCGACAGAGATGAACTCTCCTC | 84 |
| 18gVSV_2400r | GCTGCCACATCTGAGTATGTTCTG | 85 |
| 19gVSV_2000f | TCCATGACTTTCCAACCCAAGA | 86 |
| 20gVSV_2400f | CGAGATGGACACCTATGATCCGAA | 87 |

TABLE 5

List of Primers for One-step RT-PCR

| RT-PCR reaction name | Forward primer name | Reverse primer name | Expected Size(kb) |
|---|---|---|---|
| N | 1gVSVLeader_f | 10gVSV_1600r | 1.7 |
| P | 11gVSV_1200f | 18gVSV_2400r | 1.3 |
| M | 19gVSV_2000f | 24CoV_S_rvs1 | 1.1 |
| S1 | 25gVSV_2400f | 36CoV_S_rvs6 | 2.5 |
| S2 | 37CoV_S_fw5 | 49gVSV_4800r | 2.5 |
| L1 | 50CoV_S_fw10 | 59gVSV_6200r | 2.7 |
| L2 | 60gVSV_6300f | 70gVSV_8200r | 3.0 |
| L3 | 71gVSV_8300f | 82JRVSVTrailer_r | 3.0 |

TABLE 6-continued

List of Primers Used for the Sanger Sequencing of the rVSVΔG-SARS-CoV-2 Genome

| Primer name | Sequence | SEQ ID NO: |
| --- | --- | --- |
| 21gVSV_2800f2 | CTACGATGATGAGTCACTGG | 88 |
| 22gVSV_2400r | GCTGCCACATCTGAGTATGTTCTG | 89 |
| 23gVSV_2800r | CCTTTTTCTCGACAATCAGGCC | 90 |
| 24CoV_S_rvs1 | CTCTTTGTTCCATTGGTTCC | 91 |
| 25gVSV_2400f | CGAGATGGACACCTATGATCCGAA | 92 |
| 26CoV_S_fw1 | AGTGGATCCTACTCGAGAGG | 93 |
| 27CoV_S_fw2 | CATTAAAGTCTGTGAATTCC | 94 |
| 28CoV_S_fw3 | AGCAGCTGCTTACTATGTTG | 95 |
| 29CoV_S_fw4 | GTATATGCAGATTCCTTTGT | 96 |
| 30CoV_S_fw5 | ACCTAAGAAGAGCACTAATCT | 97 |
| 31CoV_S_rvs1 | CTCTTTGTTCCATTGGTTCC | 98 |
| 32CoV_S_rvs2 | GATCTCTAACTAGGTTTATAGGTGT | 99 |
| 33CoV_S_rvs3 | AGTAGCATTGAAAACCTCTC | 100 |
| 34CoV_S_rvs4 | CATTACACGGTGTGCTGCCC | 101 |
| 35CoV_S_rvs5 | GATAGAGAACGGCAACTTGA | 102 |
| 36CoV_S_rvs6 | GGAATCTCCACAGATGTACA | 103 |
| 37CoV_S_fw5 | ACCTAAGAAGAGCACTAATCT | 104 |
| 38CoV_S_fw6 | TGACATTCCAATCGGTGCCG | 105 |
| 39CoV_S_fw7 | CCATCAAGGATTTTGGAGGATTTAA | 106 |
| 40CoV_S_fw8 | GCTATAGGAAAGATTCAGGA | 107 |
| 41CoV_S_fw9 | ACATGTAACATATGTGCCCG | 108 |
| 42CoV_S_fw10 | TGATCGACCTTCAGGAGCTG | 109 |
| 43CoV_S_rvs7 | TGTAATTGTACCAGCCAACA | 110 |
| 44CoV_S_rvs8 | TGATGAGTTGTTGGGTGACG | 111 |
| 45CoV_S_rvs9 | GGAATCGAGTTCAGGTTGTA | 112 |
| 46CoV_S_rvs10 | AACGCGTAAACAGCTAGCCT | 113 |
| 47gVSVGene4_f | TTAATGTTTGGCCTGATTGTCGAGA | 114 |
| 48gVSVGene4_rev | GCGCTCATCGGGATTCAGGAA | 115 |
| 49gVSV_4800r | CCACCACGTCAAATGTTATTTC | 116 |
| 50CoV_S_fw10 | ACATGTAACATATGTGCCCG | 117 |
| 51gVSV_5300f | GGGCAACAAACCAATTGAAT | 118 |
| 52gVSV_5800f | GCAAGAGAATCAAGGCCTTTAGT | 119 |
| 53gVSV_6300f | CCCATCGATAATATACTCTGACAAA | 120 |
| 54gVSV_6800f | TCCTTAATCGAGAGAACTCATGAA | 121 |
| 55gVSV_4800r | CCACCACGTCAAATGTTATTTC | 122 |
| 56gVSV_5200r2 | ACTAAAGGCCTTGATTCTCTTGC | 123 |
| 57gVSV_5200r | GATGGGTCTAGTAAGTCGGGTATT | 124 |
| 58gVSV_6200r2 | TTCATGAGTTCTCTCGATTAAGGA | 125 |
| 59gVSV_6200r | CACTCGTGACCATCTCTTGG | 126 |
| 60gVSV_6300f | CCCATCGATAATATACTCTGACAAA | 127 |
| 61gVSV_6800f | TCCTTAATCGAGAGAACTCATGAA | 128 |
| 62gVSV_7300f | TGACCAAATACCCACTTGTGC | 129 |
| 63gVSV_7800f | CGAACTTGTTAAAGACTGAGGTTAA | 130 |
| 64JKgVSV_8300f | CGGGATCCATGACGTCTTTA | 131 |
| 65gVSV_8800f | TTTGAGACCCATAGAAGAGATCAC | 132 |
| 66gVSV_6200r | CACTCGTGACCATCTCTTGG | 133 |
| 67gVSV_7200r2 | TTAACCTCAGTCTTTAACAAGTTCG | 134 |
| 68gVSV_7200r | TGAACCCTGATGTGTTACATGG | 135 |
| 69gVSV_8200r2 | GTGATCTCTTCTATGGGTCTCAAA | 136 |
| 70gVSV_8200r | TCGTTTCTAATTCGTCTCTAATAGG | 137 |
| 71gVSV_8300f | CGGGATCCATGACGTCTTTA | 138 |
| 72gVSV_8800f | TTTGAGACCCATAGAAGAGATCAC | 139 |
| 73gVSV_9300f | CTCCTATCCGACAAGCAACC | 140 |
| 74gVSV_9800f | GAATCAGGTTGGGCCAATTA | 141 |
| 75gVSV_10300f | GAGCGAAAAGAATGCAGTAACA | 142 |
| 76gVSV_10800f | GCTTTTGGCTGAGTTTGATG | 143 |
| 77JKVSVGene6_f | AAACACAGGAATGATTGAAT | 144 |
| 78gVSV_8200r | TCGTTTCTAATTCGTCTCTAATAGG | 145 |
| 79gVSV_9200r2 | TAATTGGCCCAACCTGATTC | 146 |

TABLE 6-continued

List of Primers Used for the Sanger Sequencing of the rVSVΔG-SARS-CoV-2 Genome

| Primer name | Sequence | SEQ ID NO: |
|---|---|---|
| 80gVSV_9200r | CGCTCTCACAAATATATGTTCCATA | 147 |
| 81gVSV_10200r2 | CATCAAACTCAGCCAAAAGC | 148 |
| 82JRVSVTrailer_r | ACGAAGACCACAAAACCAGATAAA | 149 |

The Illumina Next-Generation Sequencing method was also used to determine the nucleotide sequences of the clones. A cDNA library was constructed using the KAPA RNA HyperPrep for Kit Illumina Platforms (Roche KiK8541) with KAPA Unique Dual-Indexed Adapters (Roche KiK8727) as per the manufacturer's instructions. The quality of the library was evaluated with the 4200 TapeStation system (Agilent G2991AA) and concentration determined using the Qubit dsDNA HS Assay Kit (Q32851) on the Qubit Fluorometer. The samples were pooled and sequencing was performed on the Illumina NextSeq 500 Platform using the NextSeq 500/550 High Output v2.5 kit, 300 cycles (2_151 read length). Files were demultiplexed and adapters removed (bclfastq version 2.17.1.4).

B. Results

The sequencing results confirmed that (1) there were minimal to no sequence changes in the VSV genes; (2) the clones were pure and there was no contamination; and (3) the sequence variation in each clone was fully penetrant. The sequencing results identified variations from the template genome that was present in each clone. Sequencing results are shown in Table 7. IDC-27 T1 M

TABLE 7

Mutations Present in the Sequence of Each Clone

| Source | Clone | Sequence variation |
|---|---|---|
| Round 1 | 1 | CoV2-Swt H655YCoV2-Swt R682KCoV2-Swt S1261*non-coding a6993- VSV-L R201W |
| | 2 | CoV2-Swt H655YCoV2-Swt R682KCoV2-Swt S1261*non-coding g6992GG VSV-L R201W |
| | 3 | CoV2-Swt H655YCoV2-Swt R682KCoV2-Swt S1261*VSV-L R201WVSV-L A326T |
| | 4 | CoV2-Swt H655YCoV2-Swt R682KCoV2-Swt S1261*VSV-L R201W |
| | 5 | CoV2-Swt H655YCoV2-Swt R682KCoV2-Swt S1261*VSV-L R201W |
| | 6 | CoV2-Swt H655YCoV2-Swt R682KCoV2-Swt S1261*VSV-L R201W |
| | 7 | VSV-M A216GCoV2-Swt H655YCoV2-Swt R682KCoV2-Swt S1261*VSV-L D28EVSV-L R201WVSV-L Q1986R |
| | 8 | CoV2-Swt H655YCoV2-Swt R682KCoV2-Swt S1261*VSV-L R201WVSV-L A326T |
| | 9 | CoV2-Swt H655YCoV2-Swt R682KCoV2-Swt S1261*VSV-L R201W |
| | 10 | CoV2-Swt H655YCoV2-Swt R682KCoV2-Swt S1261*VSV-L R201W |
| | 11 | CoV2-Swt H655YCoV2-Swt R682KCoV2-Swt S1261*VSV-L R201W |
| | 12 | CoV2-Swt V622ACoV2-Swt H655YCoV2-Swt R682KCoV2-Swt S1261*VSV-L R201W |
| | 13 | CoV2-Swt H655YCoV2-Swt R682KCoV2-Swt S1261*VSV-L R201W |
| | 14 | CoV2-Swt H655YCoV2-Swt R682KCoV2-Swt Silent K933CoV2-Swt S1261*VSV-L R201W |
| | 15 | CoV2-Swt H655YCoV2-Swt R682KCoV2-Swt S1261*VSV-L R201W |
| | 16 | VSV-M A216GCoV2-Swt H655YCoV2-Swt R682KCoV2-Swt S1261*VSV-L R201W |
| | 17 | CoV2-Swt H655YCoV2-Swt R682KCoV2-Swt S1261*VSV-L R201W |
| | 18 | CoV2-Swt H655YCoV2-Swt R682KCoV2-Swt S1261*VSV-L R201W |
| | 19 | CoV2-Swt H655YCoV2-Swt R682KCoV2-Swt S1261*VSV-L R201W |
| | 20 | CoV2-Swt H655YCoV2-Swt R682KCoV2-Swt S1261*VSV-L R201W |
| Plaque isolates from serum-containing medium | SC1 | non-coding c3058T CoV2-Swt R683GCoV2-Swt G1251* |
| | SC3 | CoV2-Swt H655YCoV2-Swt Silent L864CoV2-Swt G1251*VSV-L K189Qnon-coding |
| | SC7 | c13439A |
| | MB2 | CoV2-Swt H655YCoV2-Swt S1261*VSV-L Silent E2VSV-L T561A CoV2-Swt H655YCoV2-Swt G1251*VSV-L Silent I1343 |
| Plaque isolates from serum-free medium | SF1 | VSV-M E213KCoV2-Swt S1261* |
| | SF2 | VSV-M E213KCoV2-Swt N978KCoV2-Swt S1261* |
| | SF3 | VSV-P E67DCoV2-Swt H655YCoV2-Swt S940GCoV2-Swt G1251*VSV-L Silent V1701VSV-L N1849D |
| | SF4 | non-coding c3058T CoV2-Swt R683GCoV2-Swt G1251* |
| | SF5 | VSV-M A186Snon-coding c3058T CoV2-Swt R683GCoV2-Swt G1251* |
| | SF6 | VSV-M E213KCoV2-Swt N709SCoV2-Swt G1251* |
| | SF7 | VSV-M E213KCoV2-Swt N709SCoV2-Swt G1251*VSV-L Y218HVSV-L Silent D1141VSV-L Silent S1734 |
| | SF8 | VSV-M E213KCoV2-Swt N709SCoV2-Swt G1251* |
| | SF9 | VSV-M E213KCoV2-Swt Silent S46CoV2-Swt N709SCoV2-Swt D1163NCoV2-Swt G1251*non-coding a6990T VSV-L Silent N58 |
| | SF10 | VSV-P R228KVSV-M G112WSV-M A219Vnon-coding c3058T CoV2-Swt R683GCoV2-Swt D1118ACoV2-Swt G1251* |
| | SF11 | VSV-N Silent F222VSV-M Y61Snon-coding c3058T CoV2-Swt R683GCoV2-Swt S813FCoV2-Swt G1251* |
| | SF12 | VSV-M E213KCoV2-Swt Silent Y248CoV2-Swt H655YCoV2-Swt N709SCoV2-Swt G1251*VSV-L A1283WSV-L Silent H2067 |
| | SF13 | CoV2-Swt H655YCoV2-Swt S1261*VSV-L Silent I1992non-coding t13403C |
| | SF14 | VSV-M E213KCoV2-Swt N709SCoV2-Swt G1251* |
| | SF15 | VSV-M E213KCoV2-Swt N709SCoV2-Swt G1251* |
| | SF16 | VSV-M E213KCoV2-Swt N709SCoV2-Swt G1251* |
| | SF17 | non-coding c3058T CoV2-Swt R683GCoV2-Swt D1118ACoV2-Swt G1251*non-coding g13407T |
| | SF18 | VSV-M E213Knon-codmg t3074C CoV2-Swt N709SCoV2-Swt G1251*VSV-L C1076Y |

TABLE 7-continued

Mutations Present in the Sequence of Each Clone

| Source | Clone | Sequence variation |
|---|---|---|
| | SF19 | VSV-M E213KCoV2-Swt N709SCoV2-Swt G1251*VSV-L L285S |
| | MB1 | VSV-M Y61Snon-coding c3058T CoV2-Swt R683GCoV2-Swt S813FCoV2-Swt G1251* |

We did not proceed with clones that comprised the E213K mutation in the VSV-M protein as this mutation is associated with VSV attenuation. Clone MB1 comprised a Y61S mutation in the VSV-M protein, four mutations in the SARS-CoV-2 S protein—a non-coding nucleotide mutation C3058T; two amino acid substitutions R683G and S813F; and a premature stop codon at nucleotide G6852T (amino acid G1251*). The full nucleotide and amino acid sequences for clone MB1 are shown in FIGS. 24A-B. Clone MB2 comprised two mutations in the SARS-CoV-2 S protein, H655Y and G1251, and a silent 113431 mutation in the VSV-L protein. The full nucleotide and amino acid sequences for clone MB2 are shown in FIGS. 21A-G.

Example 9. Modeling Sequence Variants on SARS-CoV-2 S Protein Structure to Ensure Changes Did not Impact Critical Functional Epitopes Given that mutations were found in the SARS-CoV-2 S protein of MB1 and MB2, we used modeling to predict the impact of the identified sequence variations on the SARS-CoV-2 S protein structure. The findings from our modeling efforts for MB1 and MB2 are described in Table 8.

TABLE 8

Modeling of Sequence Variations on SARS-CoV-2 S Protein

| Mutation | Protein | Surface exposure | Type of change | Notes |
|---|---|---|---|---|
| Sequence variations in MB1 | | | | |
| R683G | SARS-CoV-2 S protein Furin site | Disordered | Basic to nonpolar | Reduces S1/S2 cleavage |
| S813F | SARS-CoV-2 S protein S2/HR1 | Disordered | Polar to nonpolar | Very close to the S2' cleavage site (R815) where cleavage exposed the fusion peptide |
| Y61S | M | Yes | Nonpolar to polar | Y61 forms a hydrogen bond with K215; K215 mutation has been found to make the virus temperature sensitive |
| Sequence variations in MB2 | | | | |
| H655Y | SARS-CoV-2 S protein SD2 | Yes | Basic to polar | Expected to promote more efficient glycosylation |

We found no predicted impact on the structural stability of SARS-CoV-2 S protein. There was also minimal to no sequence variation in the receptor binding domain of SARS-CoV-2 S protein or known binding sites for neutralizing antibodies to SARS-CoV-2 S protein.

The H655Y substitution occurs adjacent to a consensus site (NxS/T where x is any amino acid) in the SARS-CoV-2 S protein that can be modified by N-linked glycosylation. The H655Y substitution generates a sequence context that is expected to promote more efficient glycosylation at this location.

Example 10. rVSVΔG-SARS-CoV-2 S Protein Expression as Detected by Western Blot

We analyzed the expression of SARS-CoV-2 S protein in Vero cells were infected with the clone isolates (FIGS. 9 and 10A-C). Cells were harvested from 48 to 72-hour post infection. Cell lysates were prepared from infected cells using CelLytic M buffer (Sigma #C2978) supplemented with 1% protease inhibitors. Cell lysates were clarified by centrifugation at 13000 rpm for 5 min. To denature, sample was mixed with 4×LSD loading buffer (Thermofisher #NP0007) and 10× reducing buffer (ThermoFisher #NP0009), boiled at 80° C. for 10 minutes.

The denatured samples were subjected to SDS polyacrylamide gel electrophoresis, transferred to nictrocellulose membrane and incubate with blocking buffer (Thermofisher #37539) for 2 hours at room temperature. Monoclonal antibody recognizing the S2 subunit (GeneTex Cat #GTX632604) was used to probe the full-length S protein and the post-translationally cleaved S2 subunit respectively. Secondary antibody conjugated to HRP was used to allow the chemiluminescence detection of the specific bands.

Figure 10A:
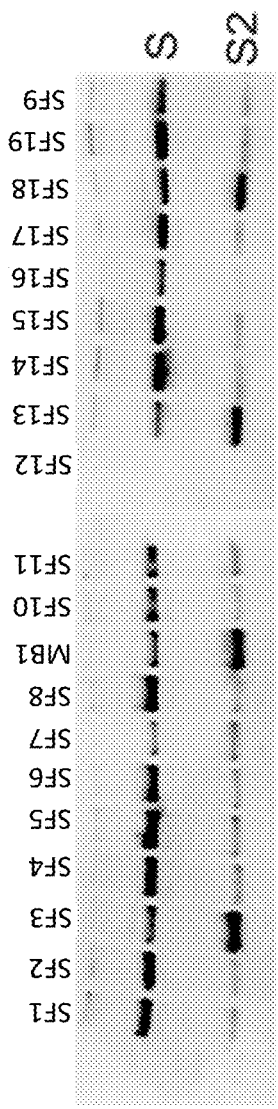
FIGS. 10A-C shows SARS-CoV S protein detected in the infected Vero cell lysate by Western blot. Monomeric (S) and dimeric (dimer) full-length SARS-CoV-2 S protein, as well as the S1 (S1) and S2 (S2) subunits are indicated. Vero cells were infected with clone isolates.
Figure 10B:
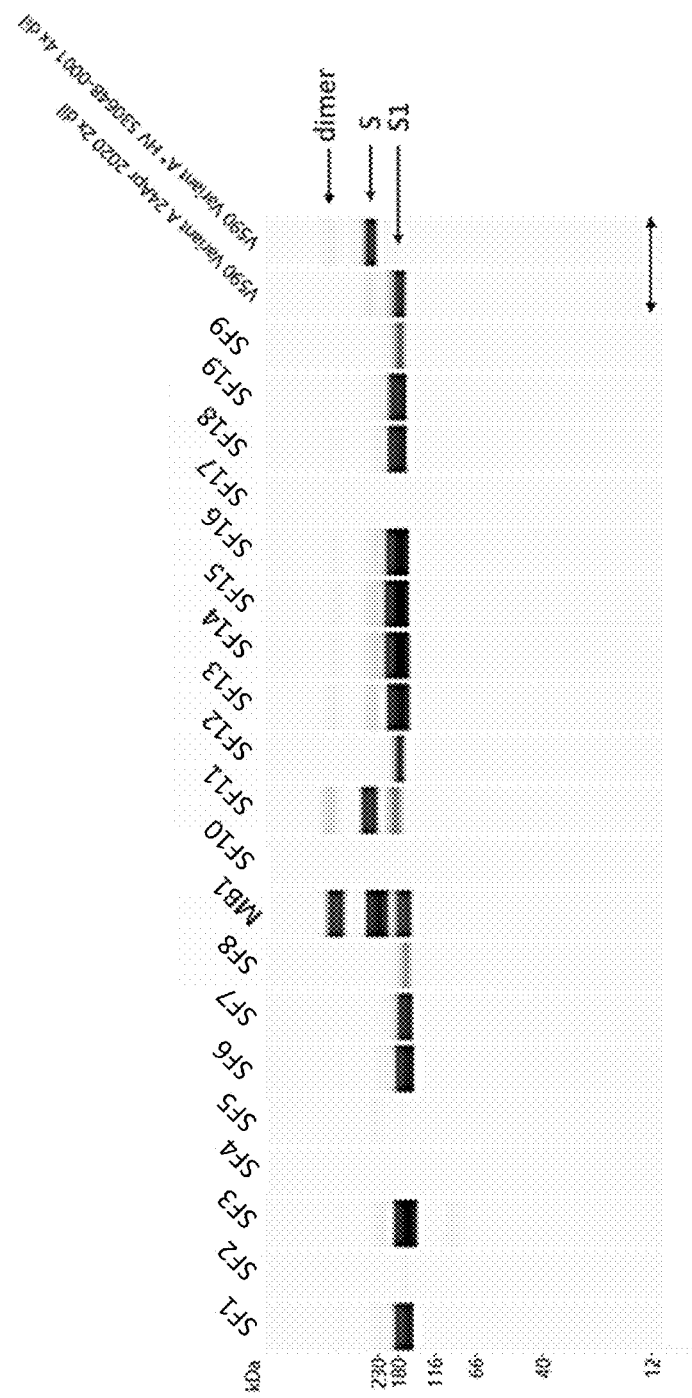
Figure 10C:
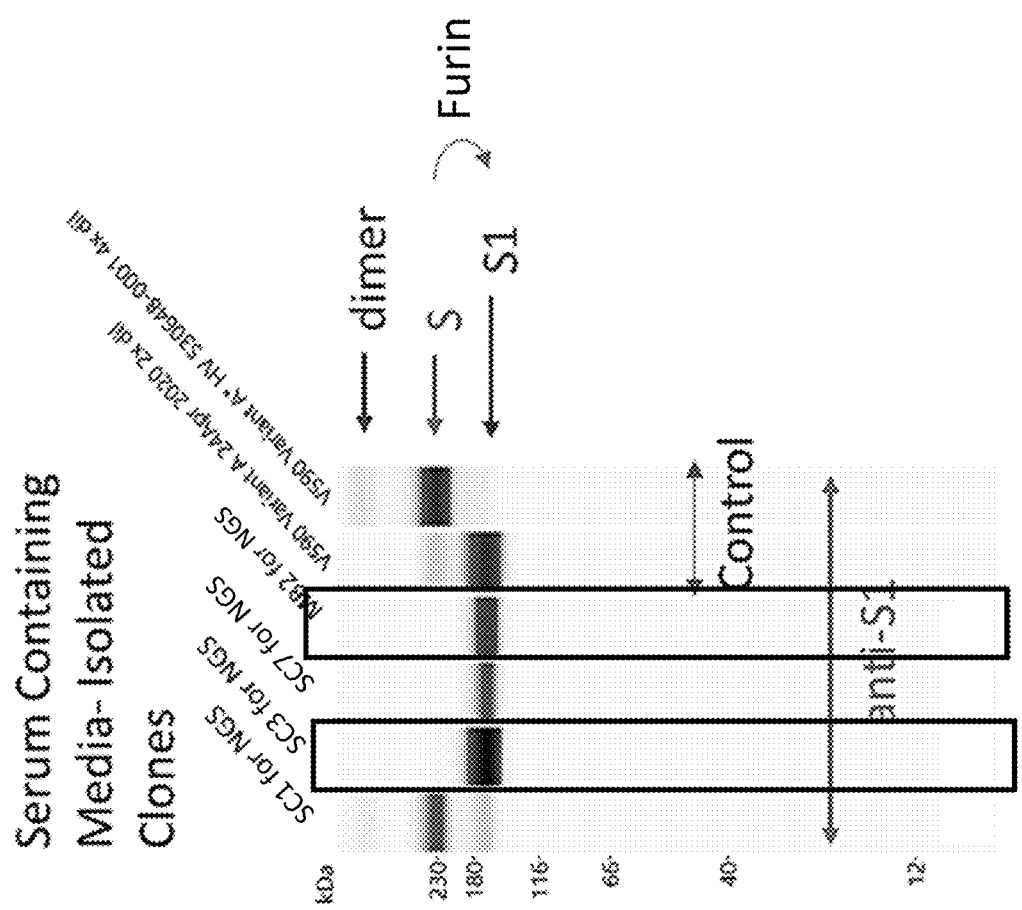

Mutations in the Furin cleavage sites affected the full-length S protein processing to S1 and S2 subunits which could be visualized on the Western (FIGS. 9 and 10A-C). For example, both clone isolates SF1 and SF2 had the R683G mutation (FIG. 10A). The amount of the S2 protein in clone isolates SF1 and SF2 were reduced compared to the clone isolate SF3 without such mutation. In FIG. 10B, clone MB1 had full-length S protein remaining as a result of reduced S1/S2 cleavage, indicative of the R683G mutation confirmed by sequencing (see Example 8 above). In FIG. 10C clone MB2, in contrast, had complete cleavage of full-length S protein.

Example 11. PRNT Assay to Evaluate Effect of Mutations in the rVSVΔG-SARS-CoV-2 S Protein We conducted a PRNT assay to determine if any of the mutations found in the rVSVΔG-SARS-CoV-2 S protein affected the ability of monoclonal antibodies (mAbs) in convalescent sera to neutralize the recombinant virus; convalescent sera were collected from individuals who were infected with SARS-CoV-2. The PRNT assay is described below in Example 15, Sections I and K. Effective neutralization of the candidate premaster seed virus was viewed was evidence that the recombinant virus was expressing SARS-CoV-2 S protein in an immunologically relevant conformation. The titers of each of the clones identified in the three groups (i.e., Round 1, serum-containing medium, and serum-free medium) are shown in FIG. 25. All of the recombinant viruses tested were neutralized by convalescent sera to varying degrees, including clones MB1 and MB2.

Figures 26A, 26B:
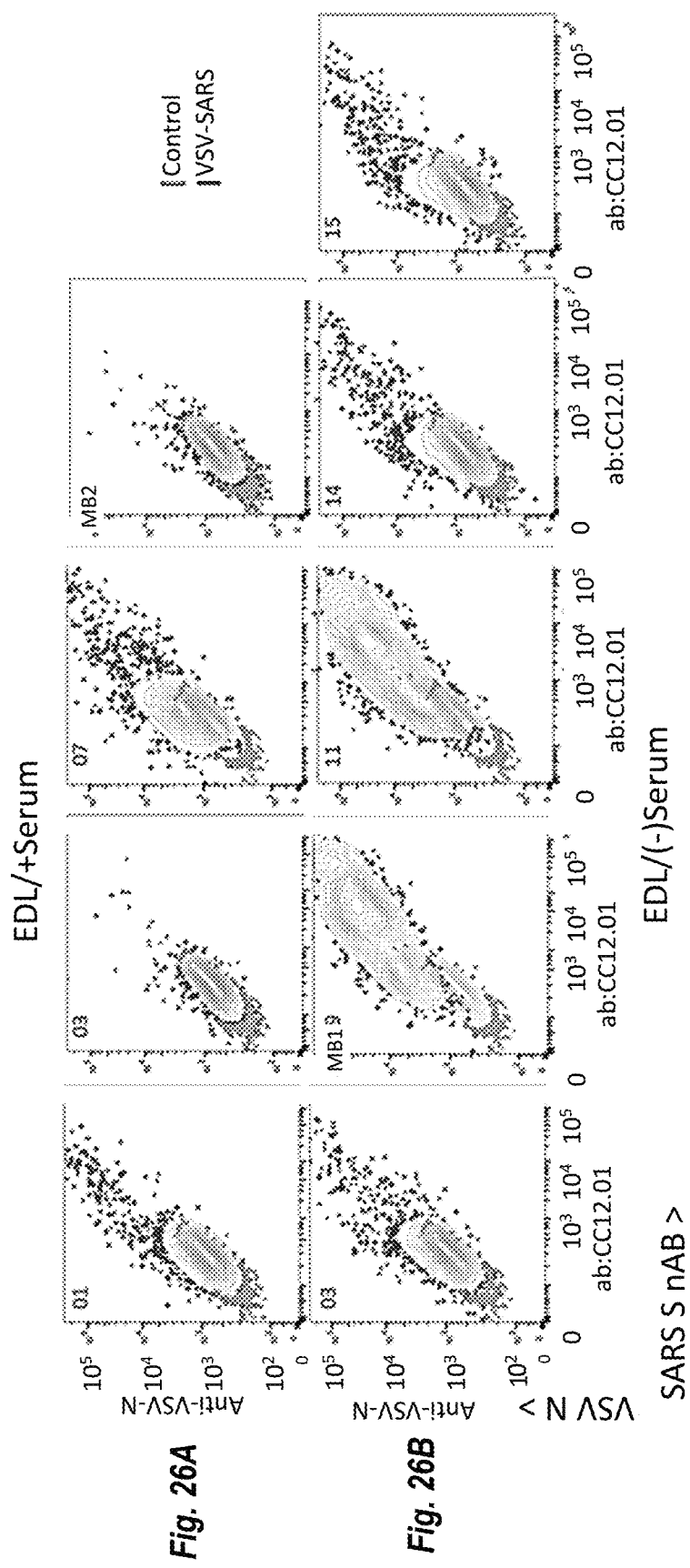
FIGS. 26A-B show flow virometry data for HeLa cells expressing ACE2 (hAVE2 cells) that were infected with recombinant virus of clone isolates.

Example 12. Ability of Recombinant VSV Particles to Infect hACE2-Expressing Cells Several clone isolates were tested to ensure that the mutations in VSVΔG-SARS-CoV-2 S protein do not prevent infection of human cells. HeLa cells expressing human ACE2 (hACE2 cells) were infected with a subset of nine clones (four isolated in serum-containing medium and five identified isolated in serum-free medium; see Example 7 above). Each infected cell line was analyzed for the level viral of infection by flow virometry (i.e., viral particles were detected by flow cytometry; FIGS. 26A and B). hACE2 cells infected with rVSVΔG-SARS-CoV-2 were visualized with anti-VSV-N antibody and anti-SARS-CoV-2 S protein antibody. Double positive cells (in the upper right hand quarter of each plot) showed the relative number of positive cells. All nine clones that were tested infected hAVE2 cells to varying degrees, with clones MB1 and SF11 having the most number of infected hACE2 cells (FIG. 26B). Sequencing results confirmed that MB1 and SF11 were genetically identical.

Figure 27:
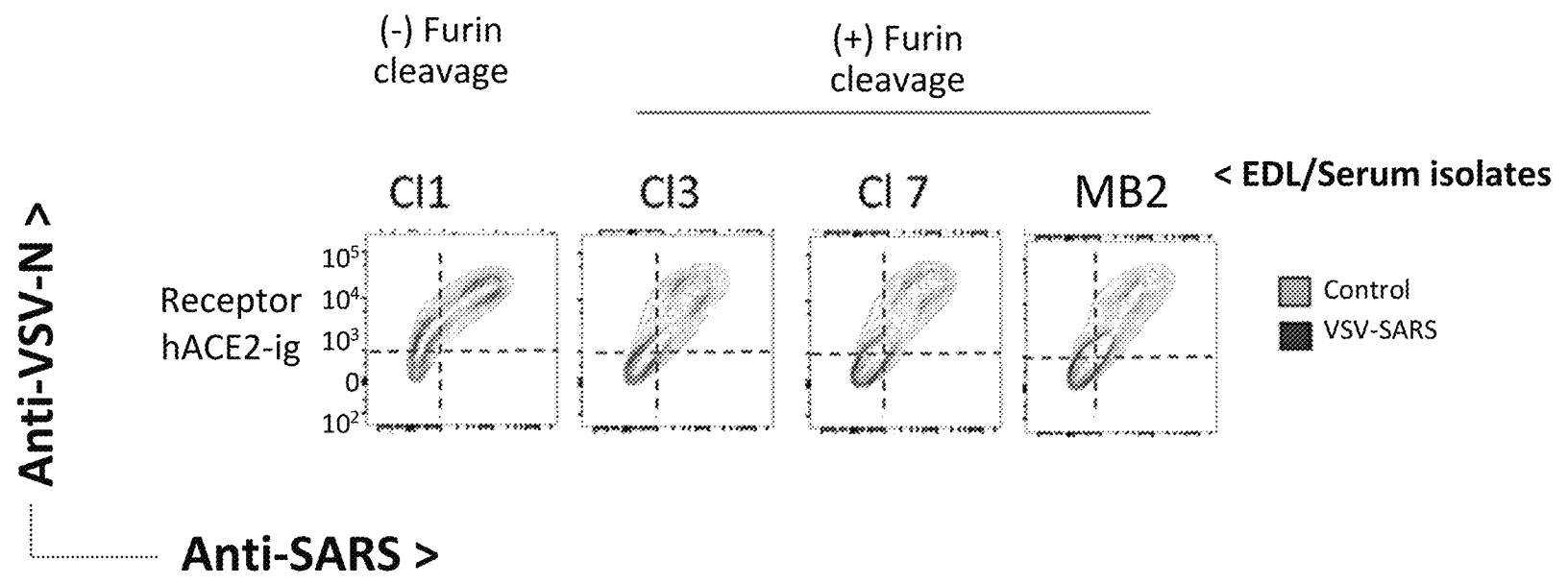

Example 13. Ability of Recombinant VSV Particles to Bind to hACE2 and Monoclonal Antibodies In order to infect cells, the SARS-CoV-2 S protein is required to bind to hACE2. Four clones previously identified in serum-free medium, clones SC1, SC3, SC7, and MB2 (see Example 7 above), were tested for binding to hACE2 to ensure that any adaptive mutations in VSVΔG-SARS-CoV-2 do not disrupt hACE2 binding. Recombinant virus of clones SC1, SC3, SC7, and MB2 were analyzed by flow virometry. Viral particles were visualized with anti-VSV-N antibody and anti-huACE2 Ig antibody. All four clones bound to bound to the anti-huACE2 Ig antibody, regardless of whether the Furin cleavage site was intact or not (FIG. 27). These results indicate that the recombinant viruses of clones SC1, SC3, SC7, and MB2 may infect human cells.

Example 14. Generation of rVSVΔG-SARS-CoV-2 S Clones MB1 and MB2

The process of generating rVSVΔG-SARS-CoV-2 S protein variants comprised serial passaging and nucleotide sequencing of transfected cells at key passages. Mutations may facilitate the adaptation of rVSVΔG-SARS-CoV-2 S protein to replicate in Vero E6 cells.

The variant rVSVΔG-SARS-CoV-2 clone MB1 was isolated in serum-free media and has a 23-amino acid C-terminal deletion. Due to the deletion, an endoplasmic reticulum retention sequence within the cytoplasmic domain of rVSVΔG-SARS-CoV-2 clone MB1 has been removed. rVSVΔG-SARS-CoV-2 clone MB1 also comprises the following mutations: R683G and S813F in the SARS-CoV-2 S protein, and Y61S in the VSV matrix protein. The clone MB1 sequence does not have a R685G or a 24-amino acid C-terminal deletion in the S protein.

The variant rVSVΔG-SARS-CoV-2 clone MB2 was isolated in serum-containing media and, like MB1, has a 23-amino acid C-terminal deletion. Due to the deletion, an endoplasmic reticulum retention sequence within the cytoplasmic domain of rVSVΔG-SARS-CoV-2 clone MB2 has been removed. rVSVΔG-SARS-CoV-2 clone MB2 also comprises the H655Y mutation the SARS-CoV-2 S protein, and Y61S in the VSV matrix protein. The clone MB2 sequence does not have a R685G or a 24-amino acid C-terminal deletion in the SARS-CoV-2 S protein.

Example 15. Immunogenicity of rVSVΔG-SARS-CoV-2 Clones MB1 and MB2 in a Hamster Model of SARS-CoV-2 Infection This example describes a nonclinical pharmacology study to evaluate the immunogenicity rVSVΔG-SARS-CoV-2 clones MB1 and MB2 and to determine if it protects against SARS-CoV-2 challenge. The Golden Syrian hamster model is suitable for the assessment as SARS-CoV-2 replicates in the hamster and aspects of COVID-19 are recapitulated post-infection (Chan J F, Zhang A J, Yuan S, Poon V K, Chan C C, Lee A C, et al. Simulation of the clinical and pathological manifestations of Coronavirus Disease 2019 (COVID-19) in golden Syrian hamster model: implications for disease pathogenesis and transmissibility. epub ahead of print: Clin Infect Dis. 2020 Mar. 26; ciaa325). The study was conducted in two parts to evaluate the ability of rVSVΔG-SARS-CoV-2 clone MB1 to protect against: (A) SARS-CoV-2-induced body weight loss; and (B) viral replication. The study also evaluated both the intramuscular (IM) injection route of administration and the oral-mucosal route of administration.

A. Test Article: rVSVΔG-SARS-CoV-2 Clones MB1 and MB2 rVSVΔG-SARS-CoV-2 clone MB1 comprises (from 5' to 3') VSV-N, VSV-P, VSV-M with Y61S, SARS-CoV-2 S protein with R683G and S813F mutations, and VSV-L.

rVSVΔG-SARS-CoV-2 clone MB2 comprises (from 5' to 3') VSV-N, VSV-P, VSV-M, SARS-CoV-2 S protein with H655Y and G1251* mutations, and VSV-L.

Descriptions and sequences for rVSVΔG-SARS-CoV-2 clones MB1 and MB2 are provided in Section II.F above; and FIGS. 21A-G and 24A-B.

The formulation for rVSVΔG-SARS-CoV-2 clone MB1 comprised 10 mM Tromethamine (Tris) and 2.5 mg/mL rice-derived recombinant human serum albumin (rHSA).

B. Control Article: SARS-CoV-2 S Protein

The control article is the SARS-CoV-2 S protein (SARS-CoV-2 pre-S-His; no tag). The protein is adjuvanted with aluminum phosphate (2%) (AdjuPhos). The formulation comprised HEPES buffer and 2% aluminum phosphate.

C. Test Animals

Table 9 provides details on test animals used in the study. Procedures involving the care and use of animals in the study were reviewed and approved by the Institutional Animal Care and Use Committee at Merck Research Laboratories. During the study, the care and use of animals were conducted in accordance with the principles outlined in the guidance of the Association for Assessment and Accreditation of Laboratory Animal Care (AAALAC), the Animal Welfare Act, the American Veterinary Medical Association (AVMA) Euthanasia Panel on Euthanasia, and the Institute for Laboratory Animal Research (ILAR) Guide to the Care and Use of Laboratory Animals. Animals were assigned to study groups randomly, with an even gender distribution each study group.

TABLE 9

Test animals.

| | |
|---|---|
| Species | *Mesoaicetus auratus* (Golden Syrian hamster) |
| Sex | Male and female |
| Source | Envigo, Indianapolis, Indiana, USA |
| Number of animals used | 54 |
| Age of animals at experiment initiation | 6 to 8 weeks old |

D. Group Designation, Dose Levels, and Dosing Schedule

Group designation, dose levels, and dosing schedule for Part A of the study are presented in Table 10 and for Part B of the study in Table 11. The study included both IM and oral-mucosal routes of administration.

TABLE 10

Group Designation, Dose Levels, and Dosing Schedule for Part A, Merck Study HAM-CoV-2-001

| Group | No. of animals | Treatment | Dose level [a] | ROA | Vol. (mL) | Challenge Dose (Day) [b] |
|---|---|---|---|---|---|---|
| 1 | 5 | None | NA | NA | NA | $2 \times 10^4$ PFU SARS-CoV-2 (Day 28 post-vaccination) |
| 2 | 5 | SARS-CoV-2 S Protein (adjuvanted with aluminum phosphate; AdjuPhos) | 10 µg (40 µg adjuvant) | IM | 0.1 | $2 \times 10^4$ PFU SARS-CoV-2 (Day 28 post-vaccination) |
| 3 | 6 | rVSVΔG-SARS-CoV-2 clone MB1 | $2.97 \times 10^6$ PFU | IM | 0.1 | $2 \times 10^4$ PFU SARS-CoV-2 (Day 28 post-vaccination) |
| 4 | 6 | rVSVΔG-SARS-CoV-2 clone MB1 | $2.97 \times 10^5$ PFU | OM | 0.01 | $2 \times 10^4$ PFU SARS-CoV-2 (Day 28 post-vaccination) |

IM = intramuscular(ly); µg = microgram(s); mL = milliliter(s); NA = not applicable; No. = number; OM = oral mucosal; PFU = plaque-forming unit(s); ROA = route of administration; SARS = Severe acute respiratory syndrome; SARS-CoV-2 = SARS-associated coronavirus-2.
[a] Nominal dose.
[b] The challenge inoculum was administered 0.1 mL per animal, 0.05 mL per nostril.

TABLE 11

Group Designation, Dose Levels, and Dosing Schedule for Part B, Merck Study HAM-CoV-2-001

| Group | No. of animals | Treatment | Dose level [a] | ROA | Vol. (mL) | Challenge Dose (Day) [b] |
|---|---|---|---|---|---|---|
| 7 | 4 | None | NA | NA | NA | $2 \times 10^4$ PFU SARS- |

TABLE 11-continued

Group Designation, Dose Levels, and Dosing Schedule for Part B, Merck Study HAM-CoV-2-001

| Group | No. of animals | Treatment | Dose level [a] | ROA | Vol. (mL) | Challenge Dose (Day) [b] |
|---|---|---|---|---|---|---|
| 8 | 4 | rVSVΔG-SARS-CoV-2 clone MB1 | $2.97 \times 10^6$ PFU | IM | 0.1 | CoV-2 (Day 28 post-vaccination) $2 \times 10^4$ PFU SARS-CoV-2 (Day 28 post-vaccination) |
| 9 | 4 | rVSVΔG-SARS-CoV-2 clone MB1 | $2.97 \times 10^5$ PFU | OM | 0.01 | $2 \times 10^4$ PFU SARS-CoV-2 (Day 28 post-vaccination) |

IM = intramuscular(ly); μg = microgram(s); mL = milliliter(s); NA = not applicable; No. = number; OM = oral mucosal; PFU = plaque-forming unit(s); ROA = route of administration; SARS = Severe acute respiratory syndrome; SARS-CoV-2 = SARS-associated coronavirus-2.
[a] Nominal dose.
[b] The challenge inoculum was administered 0.1 mL per animal, 0.05 mL per nostril.

E. Study Measurements

Serum was collected on Days 7, 14, and 26 post-vaccination in both Part A and Part B, and in Part A, on Day 42 (Day 14 post-challenge). Serum was assayed for anti-SARS-CoV-2 S protein-specific IgG titers and for anti-SARS-CoV-2 PRNT titers.

In Part B, scheduled necropsies were carried out for nares and lung tissue collection on Day 32 (Day 4 post-challenge). Processed samples were assayed for viral load.

In both Part A and Part B, body weights and clinical observations were made daily post-challenge. Clinical assessments included monitoring for signs of COVID-19, i.e., ruffled fur, hunched posture, labored breathing.

F. ELISA for Anti-SARS-CoV-2 S Protein-Specific IgG Titers

An ELISA was developed for the detection of anti-SARS-CoV-2 S protein-specific IgG antibodies in serum. Briefly, the endpoint titration method utilizes an indirect capture ELISA format in which the S1 SARS-CoV-2 S protein is used as the solid-phase immobilized antigen and horseradish peroxidase-labeled anti-hamster IgG is used for detection. The primary assay endpoint is reported as the reciprocal of the highest dilution above the assay cut point.

To coat plates, diluted SARS-CoV-2 S protein RBD-His recombinant protein, was added at 50 μL per well into half-area 96 well ELISA plates, covered, and incubated at 4° C. overnight. Plates were washed with PBST (1×PBS, pH 7.4, 0.05% Tween-20) and blocked by adding 150 μL per well of blocking buffer (PBST, 3% w/v milk) and allowed to incubate at 37° C. for 1.5 hours. A 1:100 dilution of each test serum sample was prepared using dilution solution (PBST, 2% w/v milk) in a 96-well U-bottom plate. Blocked assay plates were then washed with PBST. After adding 50 μL per well of dilution solution to the wells in columns 2-12, 75 μL per well of diluted test serum samples was added from the U-bottom plate into wells of column 1 and a 3-fold serial dilution was performed across the plate until column 11, leaving the wells in column 12 as the blank. The test serum sample-filled assay plates were then incubated at 37° C. for 1 hour. After washing assay plates with PBST, 50 μL per well of diluted secondary antibody HRP-conjugated goat anti-Golden Syrian Hamster IgG antibody (1:6,000 in dilution solution) was added to each well and incubated at 37° C. for 1 hour. After washing plates with PBST, 50 μL per well of TMB was added per well and incubated at room temperature for 10 minutes; the enzymatic reaction was stopped with addition of 50 μL per well of stop solution (2 N sulfuric acid). Absorbance at OD at 450 nm was determined using a VersaMax™ microplate reader (Molecular Devices, San Jose, California, USA) with SoftMax Pro GxP Data Acquisition software. Endpoint titers were determined using GraphPad Prism software, version 8 (GraphPad Software, San Diego, California, USA).

G. SARS-CoV-2 S Protein-Specific Pseudoneutralization Assay (PRNT) (Merck and BIOQUAL Assays)

To measure SARS-CoV-2 S protein-specific neutralizing antibodies, a pseudoneutralization assay was conducted at Merck Research Laboratories. Briefly, serial dilutions of heat inactivated test sera were mixed with an equal volume of rVSVΔG-SARS-CoV-2 clone MB1 and neutralization was allowed to proceed for 1 hour at 37° C., 5% $CO_2$. Vero African Green Monkey Kidney cells were infected with the serum/virus mixture and incubated at 37° C. for 1 hour. A methylcellulose overlay was then placed on the cells and the plates were incubated at 37° C. for 2 days. Following incubation, the methylcellulose layer was removed, plates were fixed, blocked overnight, and immunostained using a rabbit anti-SARS-CoV-2 (2019-nCoV) S protein RBD polyclonal antibody and an AlexaFluor 488-labeled goat anti-rabbit secondary antibody. Immunostained plaques were visualized and counted using the EnSight™ (PerkinElmer, Waltham, Massachusetts, USA). The primary assay endpoint is reported as the NT50 or the inverse of the dilution of serum at which 50% of the input virus is prevented from infecting cells. The assay LOD is 20.

H. Determination of Viral Load Using Quantitative Polymerase Chain Reaction (RT-qPCR)

Respiratory tract tissues were assessed for vaccine virus by RT-qPCR using standard molecular biology methods. Total RNA was isolated and reverse transcribed into cDNA. rVSVΔG-SARS-CoV-2 clone MB1 virus was quantified using PCR.

I. Statistical Analyses

For the ELISA, endpoint titers were determined as the reciprocal of the highest dilution above the assay cut point using GraphPad Prism software version 8 (GraphPad Software).

For the pseudoneutralization assay, neutralizing titers, i.e., NT50 values, were determined by 4-parameter curve fit using GraphPad Prism software v.8.1.1 (GraphPad Software) by plotting the log transformed sample dilution (x-axis) by the percent neutralization (y-axis). Percent neutralization was calculated by the following equation: 0 Neutralization=(1−[(sample plaque count−average cell control count)/(average virus control−average cell control])×100

The geometric mean titer±950 confidence interval was then determined with GraphPad Prism software.

J. Materials

Materials used in this study are provided in Table 12.

K. Results: Evaluation of Immunogenicity

Figure 16:
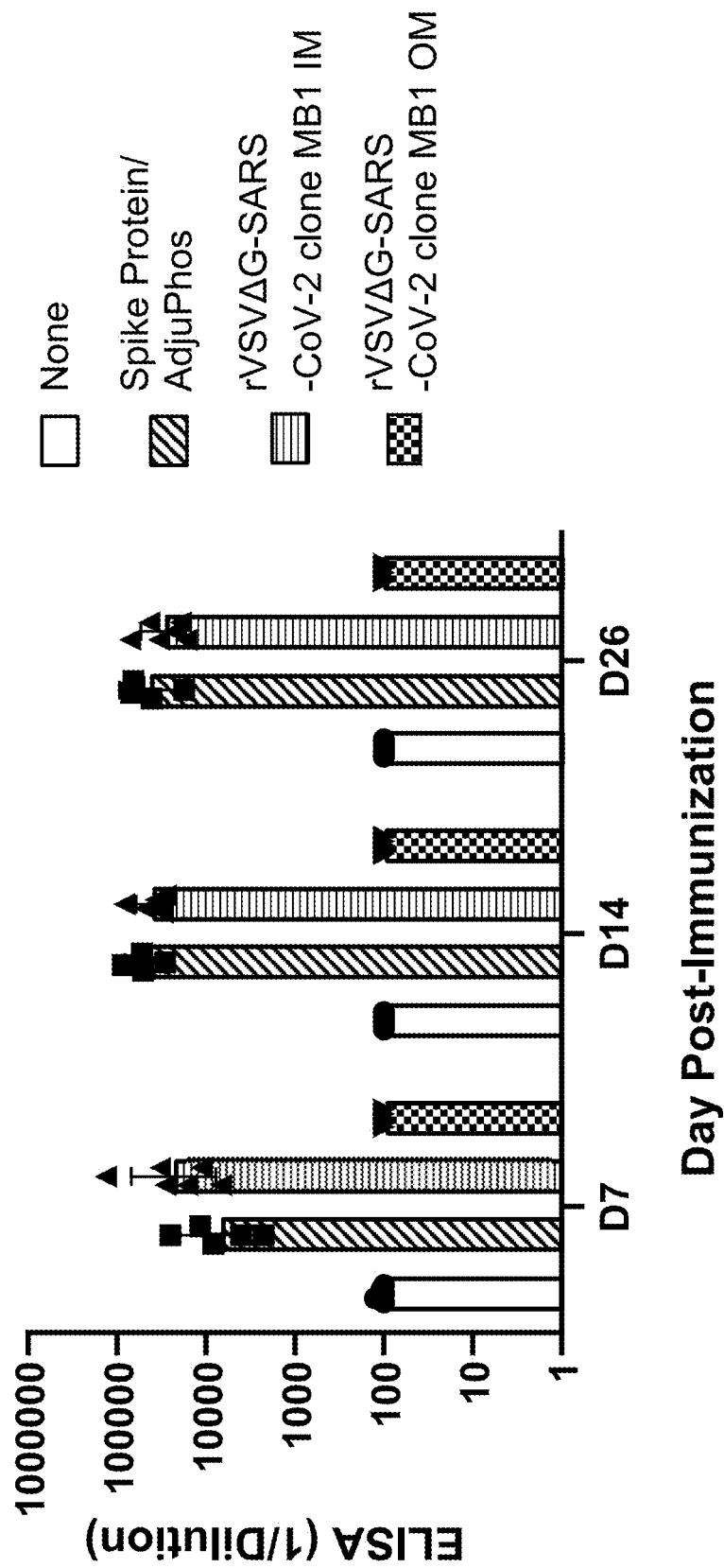
FIG. 16 shows post-vaccination anti-SARS-CoV-2 spike protein-specific immunoglobulin (IgG) enzyme-linked immunosorbent assay (ELISA) titers through day 26 from Study HAM-CoV-2-001 Part A. The immunogenicity of rVSVΔG-SARS-CoV-2 clone MB1 and its ability to protect against SARS-CoV-2 challenge was studied in Golden Syrian hamster model of SARS-CoV-2 infection. Hamsters were administered rVSVΔG-SARS-CoV-2 clone MB1 via intramuscular (IM) or oral mucosal (OM) routes, or received a vaccine consisting of the SARS-CoV-2 S protein adjuvanted with aluminum phosphate (AdjuPhos) as described in Tables 10 and 11. We evaluated the ability of rVSVΔG-SARS-CoV-2 clone MB1 to protect against SARS-CoV-2-induced body weight loss. Serum samples were collected on Days 7, 17, and 26 post-immunization, and on Day 14 post-challenge. Serum samples were analyzed for SARS-CoV-2-S protein-specific IgG titers on Days 7, 14, and 26 in an ELISA. rVSVΔG-SARS-CoV-2 clone MB1 did not demonstrate anti-S protein-specific IgG titers after OM administration at Day 7, 14, or 26 post-vaccination, with titers similar to non-vaccinated animals.
Figure 17A:
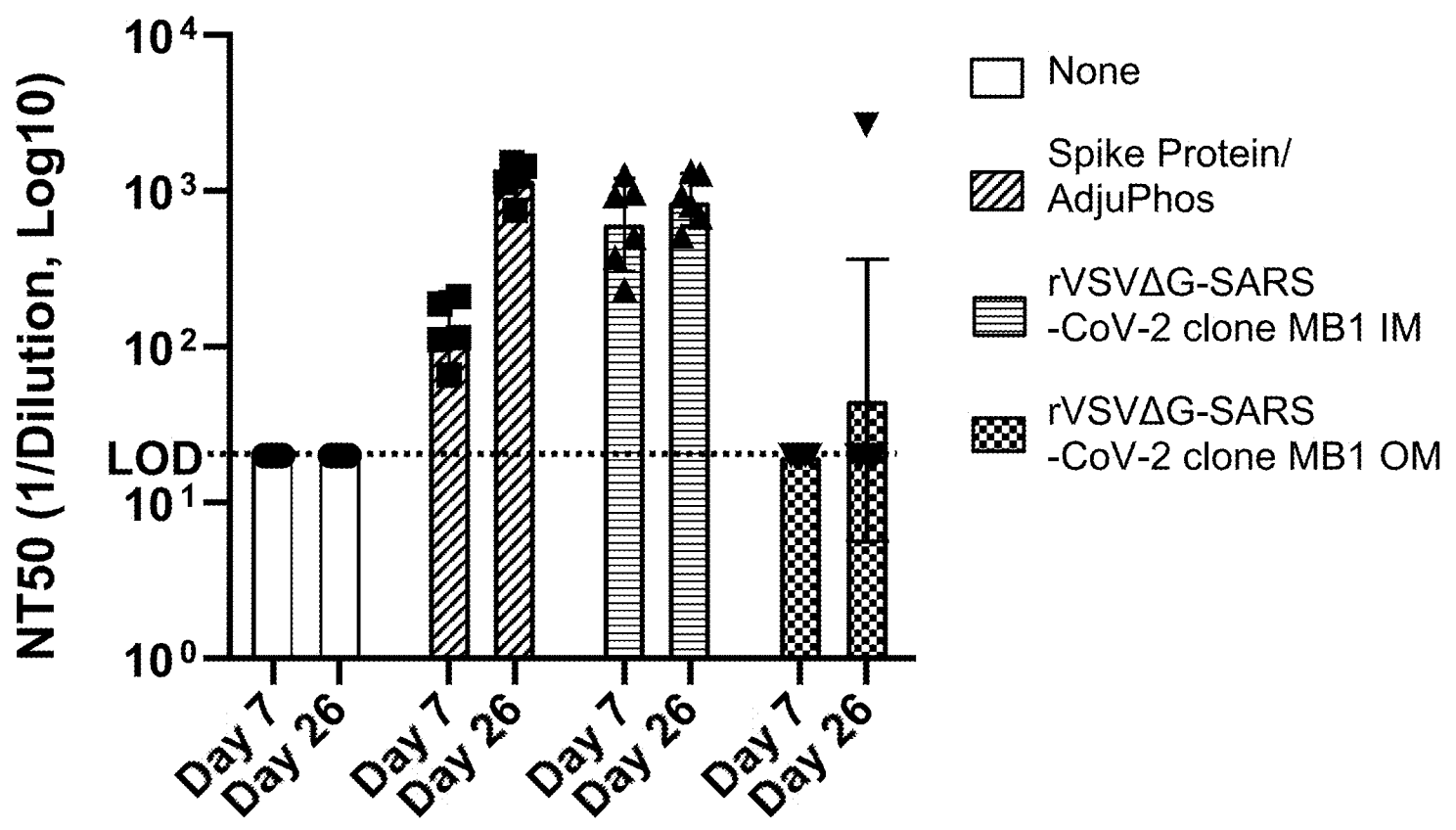
Figure 17B:
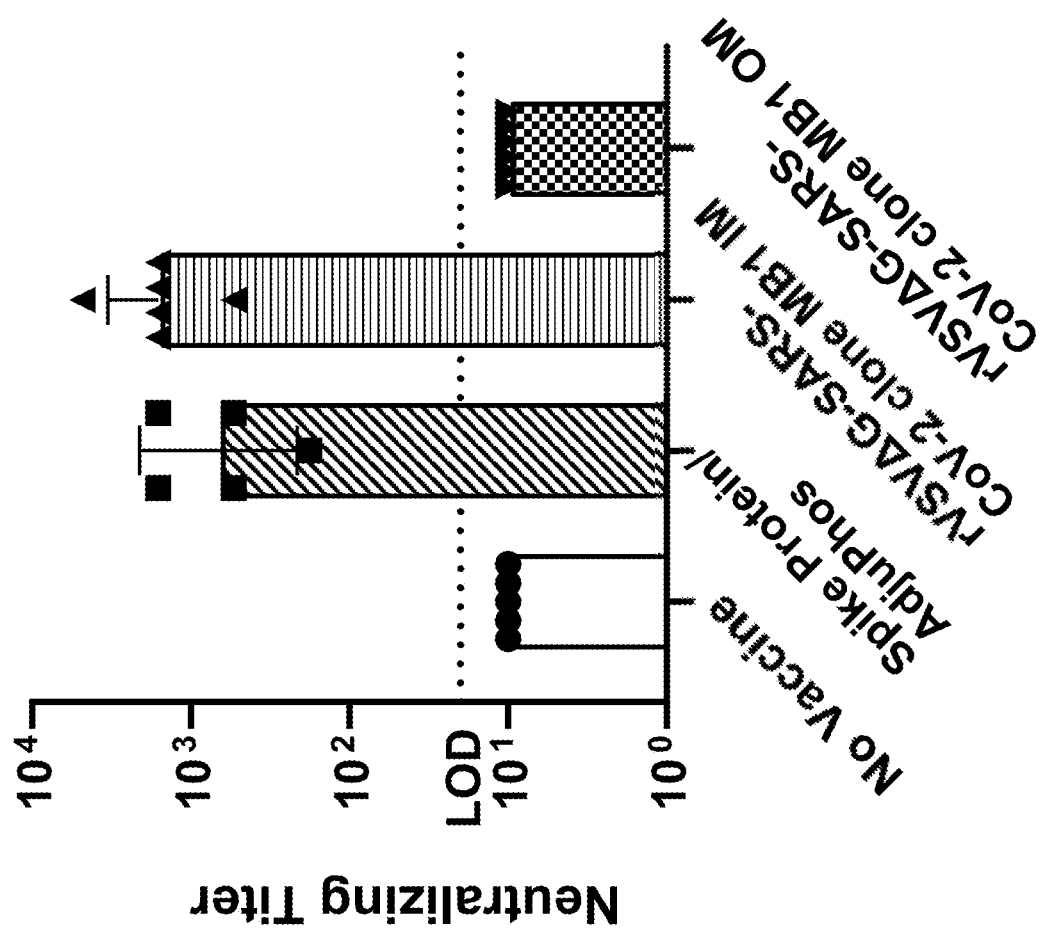

Post-vaccination ELISA titers for Part A are shown in FIG. 16 though Day 26. Post-vaccination PRNT neutralizing titers for Part A are shown in FIG. 17A for Days 7 and 26 (Merck), and in FIG. 17B for Day 14. Preliminary data through Day 26 suggest immunogenicity responses were initiated post-vaccination for rVSVΔG-SARS-CoV-2 clone MB1 by the IM route of administration.

Figure 18:
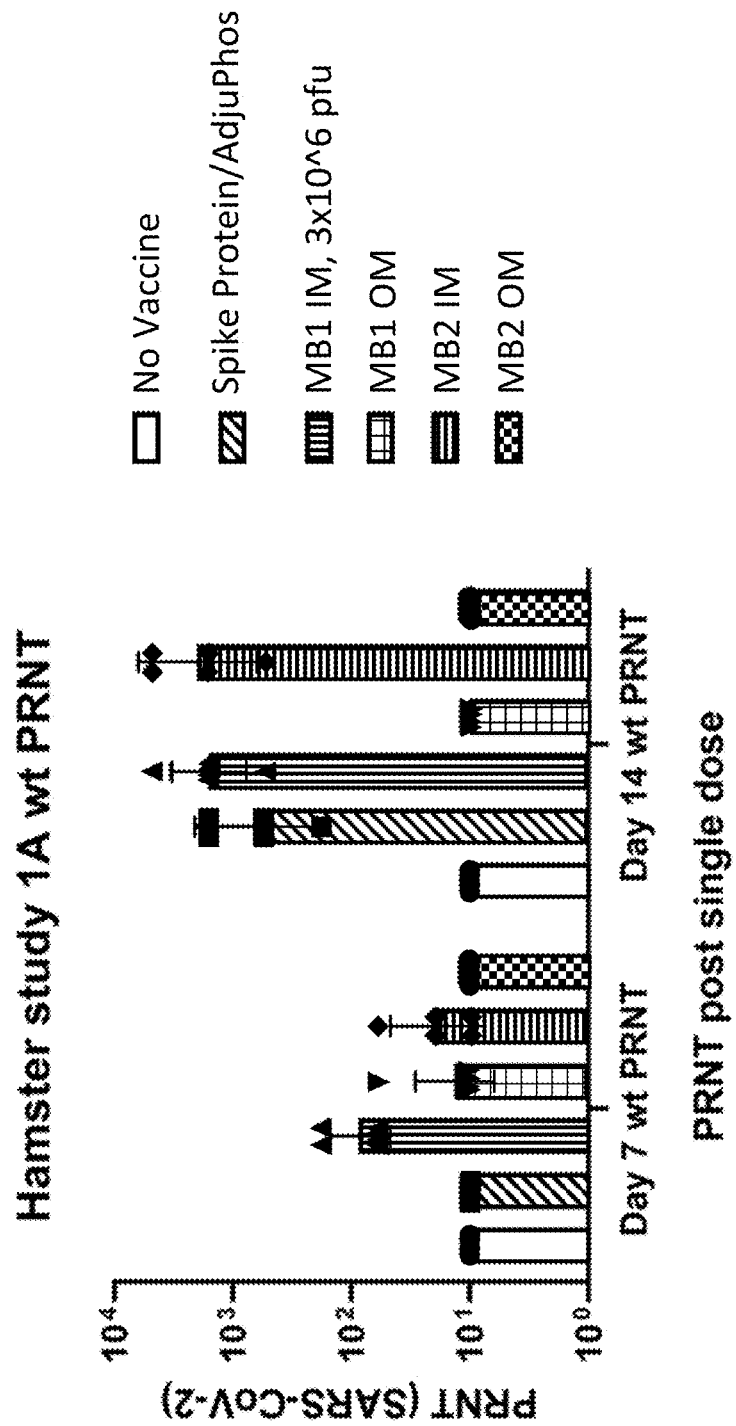
FIG. 18 shows post-vaccination SARS-CoV-2 titers (a PRNT assay) on days 7 and 14 from Study HAM-CoV-2-001 Part A.
Figure 19A:
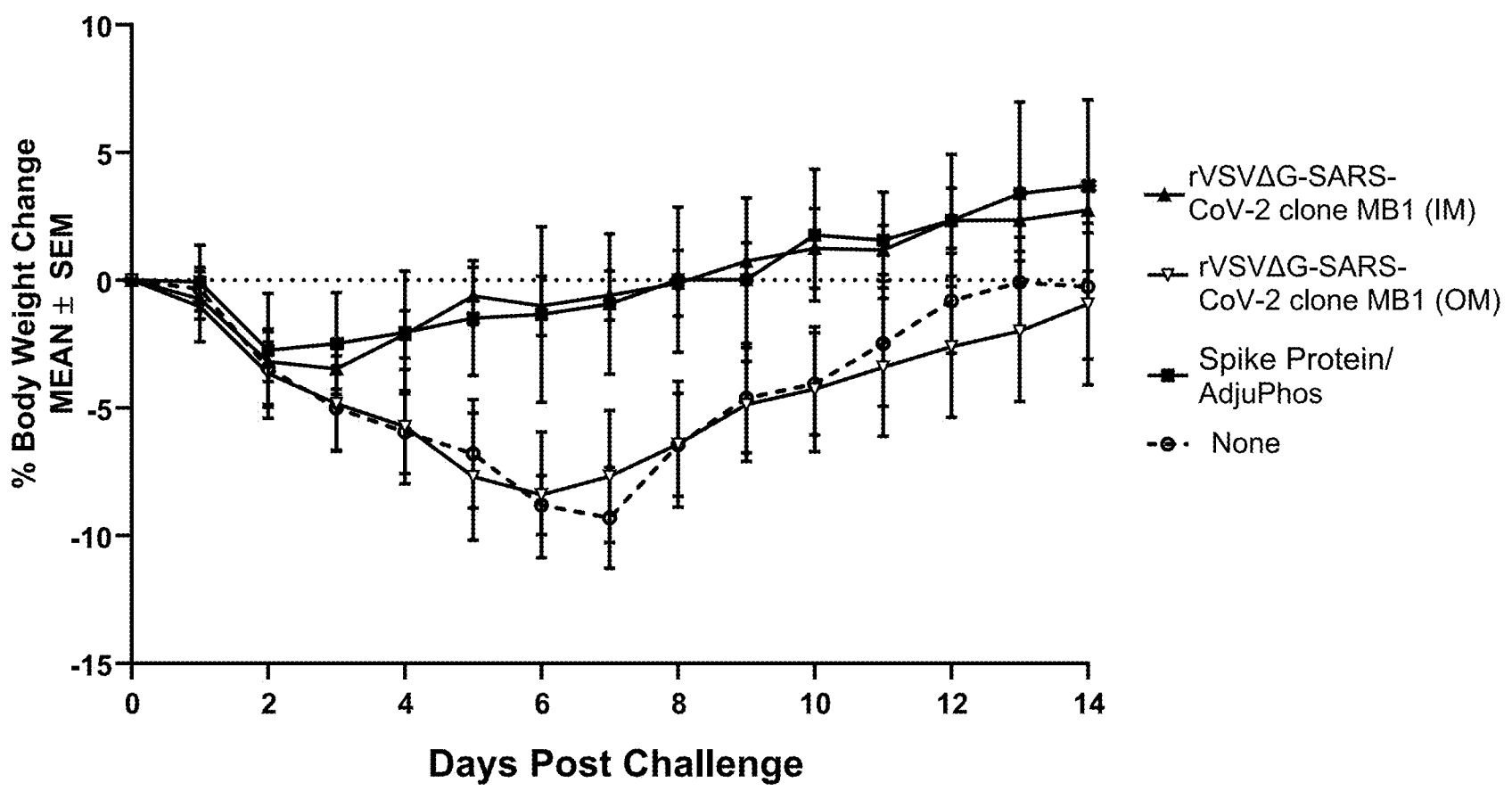
Figure 19B:
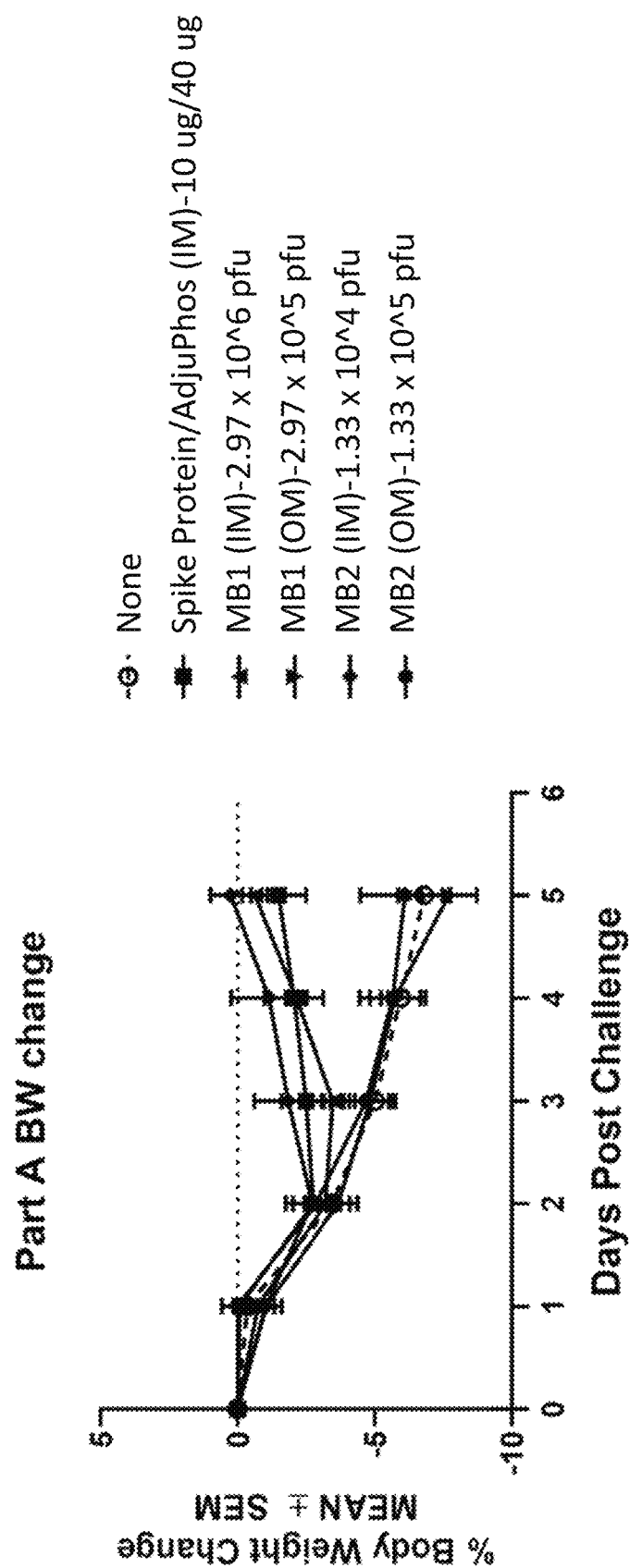
Figure 19C:
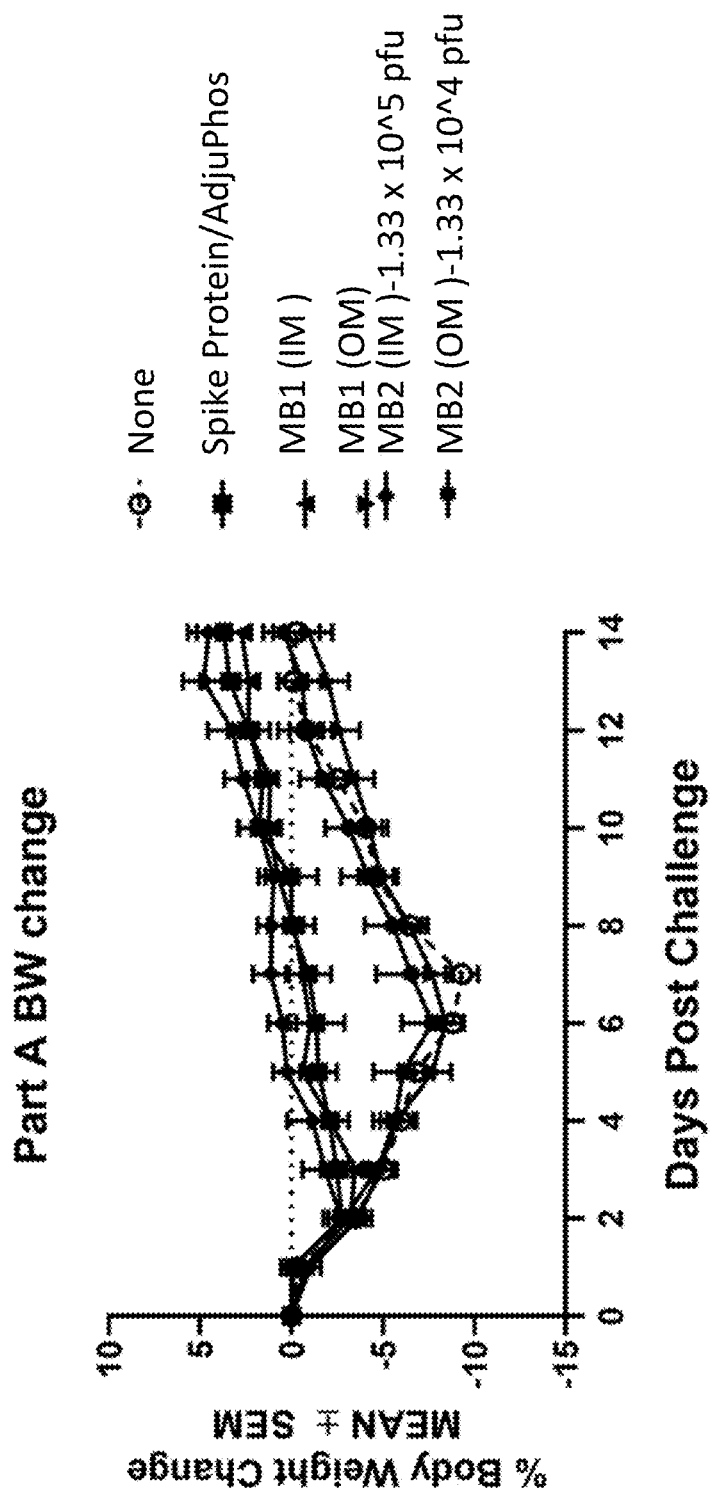

PRNT neutralizing titers after 7 and 14 days following a single immunization are shown in FIG. 18. MB1 and MB2 showed comparable immunogenicity following IM administration. Results: Part A—Assessment of Protection Against Cody Weight Loss After SARS-CoV-2 Challenge Body weight loss is a sign of COVID-19 in the hamster model of SARS-CoV-2 infection (Chan et al, 2020). Body weight (B3W) loss was assessed for 5 days post-challenge in Part A of the study. As shown in FIGS. 19A-C, IM administration of rVSVΔG-SARS-CoV-2 clones MB1 and MB2 protected animals from BW loss post-challenge. OM admin-

TABLE 12

| List of Materials | | |
|---|---|---|
| Material | Vendor | Catalog no./reference |
| SARS-CoV-2 challenge stock, isolate USA-WA1/2020 | BEI Resources | NR-52281 |
| ELISA | | |
| SARS-CoV-2 (COVID-19) S Protein RBD-His Recombinant Protein | SinoBiological | Cat. no. 40592-V08H |
| Goat Anti-Golden Syrian Hamster IgG(H + L) Antibody HRP conjugated | Rockland | Cat. no. 607-1302 |
| Assay control: SARS-CoV/ SARS-CoV-2 (COVID-19) S protein S2 antibody [1A9] | GeneTex | Cat. no. GTX632604 |
| Assay control: SARS-CoV/SARS-CoV-2 S protein antibody, Chimeric Mab | SinoBiological | Cat. no. 40150-D001 |
| Tween-20 | Sigma Aldrich | Cat. no. P9416 |
| Blotting-Grade Blocker (300 g, nonfat dry milk) | Fisher Scientific | Cat. no. 1706404 |
| Dulbecco's phosphate-buffered saline, 1X without calcium and magnesium | Corning | Cat. no. 21-031-CV |
| Pierce 1-Step Ultra ® TMB-ELISA | ThermoScientific | Cat. no. 34029 |
| ELISA Coating Buffer (5X) | BioLegend | Cat. no. 421701 |
| Sulfuric acid, 2N | Fisher Scientific | Cat. no. MK-H381-1 |
| Costar ® Assay Plate, 96 well, Clear, Flat Bottom, Half-area, High-Binding, Polystyrene, Non-Sterile | Corning | Cat. no. 3690 |
| Falcon Tissue Culture Plate, 96 well, U-Bottom with Low Evaporation Lid | BD Biosciences | Cat. no. 353227 |
| PENT Assay | | |
| rVSVΔG-SARS-CoV-2 clone MB1 ($1^{st}$ lot); titer = 5.7 × $10^7$ PFU/mL | Merck Research Laboratories | NB-Barrcoll-5030085-0024 NB-hartmame-5031563-0019 |
| VERO cells (African green monkey kidney epithelial cells) | ATCC | CCL-81 |
| Fixation solution: 3.7% Formaldehyde (Methanol Free) 10% UltraPure EM Grade) diluted in PBS | Polysciences, Inc. | Cat. no. 04018 |
| Primary Antibody: SARS-CoV-2 (2019-nCoV) S protein RBD Antibody, Rabbit PAb, Antigen Affinity Purified | SinoBiological | Cat. no. 40592-T62 |
| Secondary Antibody: AlexaFluor 488 goat anti-rabbit IgG (H7L) | Life Technologies | Cat. no. A1 1008 |
| BIOQUAL assay: SARS-CoV-2 isolate USA-WA1/2020 | BEI Resources | NR-52281 |

COVID-19 = coronavirus disease of 2019; ELISA = enzyme-linked immunosorbent assay; H + L = heavy and light chain; His = histidine; IgG = immunoglobulin G; no. = number; MAb = monoclonal antibody; PAb = polyclonal antibody; PBS = phosphate-buffered saline; SARS-CoV-2 = Severe Acute Respiratory Syndrome Coronavirus 2; TMB = 3,3',5,5'-tetramethylbenzidine; USA = United States of America.

istration of rVSVΔG-SARS-CoV-2 either clone did not offer protection against BW loss, with loss similar to non-vaccinated animals.

L. Conclusions

Data through Day 26 suggest immunogenicity responses were initiated post-vaccination for rVSVΔG-SARS-CoV-2 clones MB1 (nucleic acid SEQ ID NO: 150 or amino acid sequences SEQ ID NOS: 151-153, 155, and 156) and MB2 (nucleic acid SEQ ID NO: 154 or amino acid sequences 152 and 155-158) by the IM route of administration as seen by anti-SARS-CoV-2 S protein IgG titers and SARS-CoV-2 PRNT titers.

Single-dose IM administration of rVSVΔG-SARS-CoV-2 clone MB1 protected animals from BW loss post-challenge, suggesting a protection against COVID-19.

Single-dose OM administration of rVSVΔG-SARS-CoV-2 clone MB1 did not protect animals from BW loss post-challenge, suggesting there was inadequate protection against COVID-19. This aligns with the low immunogenicity responses observed in the ELISA and PRNT assays.

Example 16. Single-Nucleotide Polymorphisms (SNPs) in rVSVΔG-SARS-CoV-2 Clone MB1 (Nucleic Acid Sequence SEQ ID NO: 150 or Amino Acid Sequences SEQ ID NOS: 151-153, 155, and 156)

rVSVΔG-SARS-CoV-2 clone MB1, SEQ ID NO: 150, comprises a variant of the codon-optimized nucleotide sequence of rVSVΔG-SARS-CoV-2 S protein, SEQ ID NO: 160. Tables 13 and 14 summarize SNPs for rVSVΔG-SARS-CoV-2 clone MB1 (nucleic acid sequence SEQ ID NO: 150 or amino acid sequences SEQ ID NOS: 151-153, 155, and 156) relative to the expected nucleic acid SEQ ID NO: 150.

Example 17. SNPs in rVSVΔG-SARS-CoV-2 Clone MB2 (Nucleic Acid Sequence SEQ ID NO: 154 or Amino Acid Sequences SEQ ID NOS: 152 and 155-158)

rVSVΔG-SARS-CoV-2 clone MB2, SEQ ID NO: 154 comprises a variant of the codon-optimized rVSVΔG-SARS-CoV-2 S protein gene, SEQ ID NO: 158. The rVSVΔG-SARS-CoV-2 clone MB2 was identified after one round of clonal isolation. Tables 15 and 16 summarize SNPs for rVSVΔG-SARS-CoV-2 clone MB2 (nucleic acid sequence SEQ ID NO: 154 or amino acid sequences SEQ ID NOS: 152 and 155-158) relative to the expected wildtype SEQ ID NO: 159 for the S protein.

TABLE 15

SNP summary for rVSVΔG-SARS-CoV-2 clone MB2

| Position | Ref | Var | Plaque 13 |
|---|---|---|---|
| 5064 | C | T | 1.00 |
| 6852 | G | T | 1.00 |
| 6993 | A | — | * |
| 11041 | C | A | 1.00 |
| 11098 | C | A | 0.05 |
| 13434 | G | A | 0.12 |
| 13436 | C | A | 0.33 |

TABLE 13

SNP summary for rVSVΔG-SARS-CoV-2 clone MB1

| Position | Ref | Variant call freq, pct | Variant | Total coverage depth | Variant call depth | Variant call disbalance (F/R, closer to 1 is better) | Variant call entropy (closer to 1 is better) | Is the variant call major or minor variant? | Confidence in variant call |
|---|---|---|---|---|---|---|---|---|---|
| 6852 | G | 99.9 | T | 608675 | 608317 | 0.95 | 0.82 | major variant | High |
| 5064 | C | 99.9 | T | 468358 | 467908 | 0.90 | 0.85 | major variant | High |
| 11041 | C | 99.9 | A | 435606 | 435140 | 1.12 | 0.85 | major variant | High |
| 13438 | T | 54.4 | C | 195 | 106 | 0.93 | 0.62 | major variant | High |

Single nucleotide variant (SNV) calls ≥5% frequency with confidence calculations (indels excluded).

TABLE 14

Summary for position 6993-A

| Position 6993-A | Sample 24 |
|---|---|
| HIVE coverage at 6993 | 171326 |
| Ref gaaaaaaaac (SEQ ID NO: 194) | 7781 |
| Var g-aaaaaaac | 141410 |
| Var-A frequency | 0.83 |

TABLE 16

Summary for position 6993

| Position 6993 | Plaque 13 |
|---|---|
| gaaaaaaaac (SEQ ID NO: 194) | 392 |
| gaaaaaaac | 16 |
| var frequency* | 0.04 |

Example 18. Immunogenicity of rVSVΔG-SARS-CoV-2 Clone MB1 in a Hamster Model of SARS-CoV-2 Infection Following Mucosal Application This example describes a nonclinical pharmacology study to evaluate the immunogenicity pf rVSVΔG-SARS-CoV-2 clone MB1 to determine if it protects against SARS-CoV-2 challenge. The Golden Syrian hamster model used here is as described in Example 15 above. The study was conducted in two parts to evaluate the ability of mucosal administration of rVSVΔG-SARS-CoV-2 clone MB1—A) to generate a neutralizing antibody response against SARS-CoV-2 pseudovirus; and B) to protect against SARS-CoV-2 replication in the nose and lung of challenged hamsters. The study evaluated both the oral-mucosal (OM), oral (PO), intranasal+oral-mucosal (IN+OM) and intramuscular (IM) injection routes of administration.

A. Test Article: rVSVΔG-SARS-CoV-2 Clone MB1

The composition and formulation of test article rVSVΔG-SARS-CoV-2 clone MB1 were as described in Example 15.A above.

Description and sequence for rVSVΔG-SARS-CoV-2 clone MB1 is provided in Section II.F above, and FIGS. 21A-G and 24A-B.

B. Test Animals

Details on test animals were as described in Example 15.C and Table 9 above.

C. Group Designation, Dose Levels, and Dosing Schedule

Group designation, dose levels, and dosing schedule for the study are shown in Table 17.

TABLE 17

Group Designation, Dose Levels and Dosing Schedule

| Group | No. of animals | Treatment (SD0) | Route | Dose | Challenge Dose (Day) [a] |
|---|---|---|---|---|---|
| 1 | 10 | PBS | IM | NA | $2 \times 10^4$ PFU SARS-CoV-2 (Day 28 post-vaccination) |
| 2 | 10 | MB1 | IM | 3.00E+06 | $2 \times 10^4$ PFU SARS-CoV-2 (Day 28 post-vaccination) |
| 3 | 10 | MB1 | IM | 1.00E+05 | $2 \times 10^4$ PFU SARS-CoV-2 (Day 28 post-vaccination) |
| 4 | 10 | MB1 | IM | 1.00E+03 | $2 \times 10^4$ PFU SARS-CoV-2 (Day 28 post-vaccination) |
| 5 | 10 | MB1 | OM | 3.00E+05 | $2 \times 10^4$ PFU SARS-CoV-2 (Day 28 post-vaccination) |
| 6 | 10 | MB1 | PO | 3.00E+06 | $2 \times 10^4$ PFU SARS-CoV-2 (Day 28 post-vaccination) |
| 7 | 10 | MB1 | IN + OM | 3.00E+05 | $2 \times 10^4$ PFU SARS-CoV-2 (Day 28 post-vaccination) |
| 8 | 10 | MB1 | OM | 3.00E+05 | $2 \times 10^4$ PFU SARS-CoV-2 (Day 28 post-vaccination) |

IM = intramuscular; OM = oral mucosal; PO = oral; IN+OM = intranasal + oral mucosal; NA = not applicable; No. = number; PFU = plaque-forming unit(s); SD0 = Study Day Zero (0); SARS = Severe acute respiratory syndrome; SARS-CoV-2 = SARS-associated coronavirus-2.
[a] The challenge inoculum was administered 0.1 mL per animal, 0.05 mL per nostril.

D. Study Measurements

Serum was collected on Days 7, 14, and 28 post-vaccination. Serum was assayed for anti-SARS-CoV-2 S protein-specific IgG titers and for anti-SARS-CoV-2 PRNT titers.

Scheduled necropsies were carried out for nares and lung tissue collection on Day 32 (Day 4 post-challenge). Processed samples were assayed for viral load.

E. ELISA for Anti-SARS-CoV-2 S Protein-Specific IgG Titers

The ELISA assays were as described in Example 15.F above.

F. SARS-CoV-2 S Protein-Specific Pseudoneutralization Assay (PRNT) (Merck and BIOQUAL Assays)

The pseudoneutralization assays were as described in Example 15.G above.

G. Determination of Viral Load Using $TCID_{50}$

A $TCID_{50}$ assay was conducted by BIOQUAL using their SOP BV-008. Vero E6 cells (ATCC cat. no. CRL-1586) were plated at 25,000 cells/well in DMEM+10% FBS+Gentamicin and the cultures were incubated at 37° C., 5.0% $CO_2$. Cells should be 80% to 100% confluent the following day. Medium was aspirated and replaced with 180 μL of DMEM+2% FBS+gentamicin. Twenty (20) L of sample was added to top row in quadruplicate and mixed using a P200 pipettor 5 times. Using the pipettor, 20 μL was transferred to the next row, and repeated down the plate (columns A-H) representing 10-fold dilutions. The tips were disposed for each row and repeated until the last row. Positive (virus stock of known infectious titer in the assay) and negative (medium only) control wells were included in each assay set-up. The plates were incubated at 37° C., 5.0% $CO_2$ for 4 days. The cell monolayers were visually inspected for cytopathic effects (CPE). Non-infected wells had a clear confluent cell layer while infected cells have cell rounding. The presence of CPE was marked on the lab form as a "+" and absence of CPE as "−". The assay was controlled by obtaining a TCID$_{50}$ value of the positive control within 2-fold of the expected value. The TCID$_{50}$ value was calculated using the Read-Muench formula and bar graphed using GraphPad Prism software version 8 (GraphPad Software)

H. Statistical Analyses

Statistical analyses methods for ELISA and the pseudoneutralization assay were as described in Example 15.1 above.

I. Determination of Viral Load or Serum Neutralizing Capacity Using TCID50 Assay (BIOQUAL)

The viral load in respiratory tract tissue samples and in serum samples was determined using the TCID50 assay and was conducted by BIOQUAL, Inc. per BIOQUAL procedure 100011.00.006.

The TCID50 assay quantifies viral infectious units by determining the cytopathic effect of samples on Vero E6 cells. Vero E6 cells have been subcloned for high expression of ACE2.

Briefly, Vero E6 cells were plated at 25,000 cells per well in DMEM containing 10% FBS and gentamicin, and incubated at 37° C., 5% carbon dioxide until cells were 80 to 100% confluent. Media was replaced in each well with 180 μL DMEM containing 2% FBS and gentamicin. Each sample was added as 20 μL in quadruplicate wells. Solutions in each well were mixed by trituration, and samples were then serially diluted ten-fold across the plate by transferring 20 μL into the next well, changing tips after each transfer. Sample plates were then incubated at 37° C., 5% carbon dioxide for 4 days. After 4 days each well was visually inspected for cytopathic effect. Wells with no sample, i.e., non-infected wells, were confirmed as having a clear confluent cell layer. The presence of cytopathic effect was noted and the TCID50 calculated using the Reed-Muench formula (Reed and Muench, 1938). The TCID50 of the positive control was confirmed to be within 2-fold of the expected value.

The limit of detection was determined to be 250 TCID50 per 0.2 g tissue. Serum capacity to prevent infection was determined using the TCID50 assay and expressed as IC90 and IC50 values.

J. Materials

Materials used in this study were as provided in Example 15.J and Table 12 above.

K. Results: Evaluation of Immunogenicity

Figure 28:
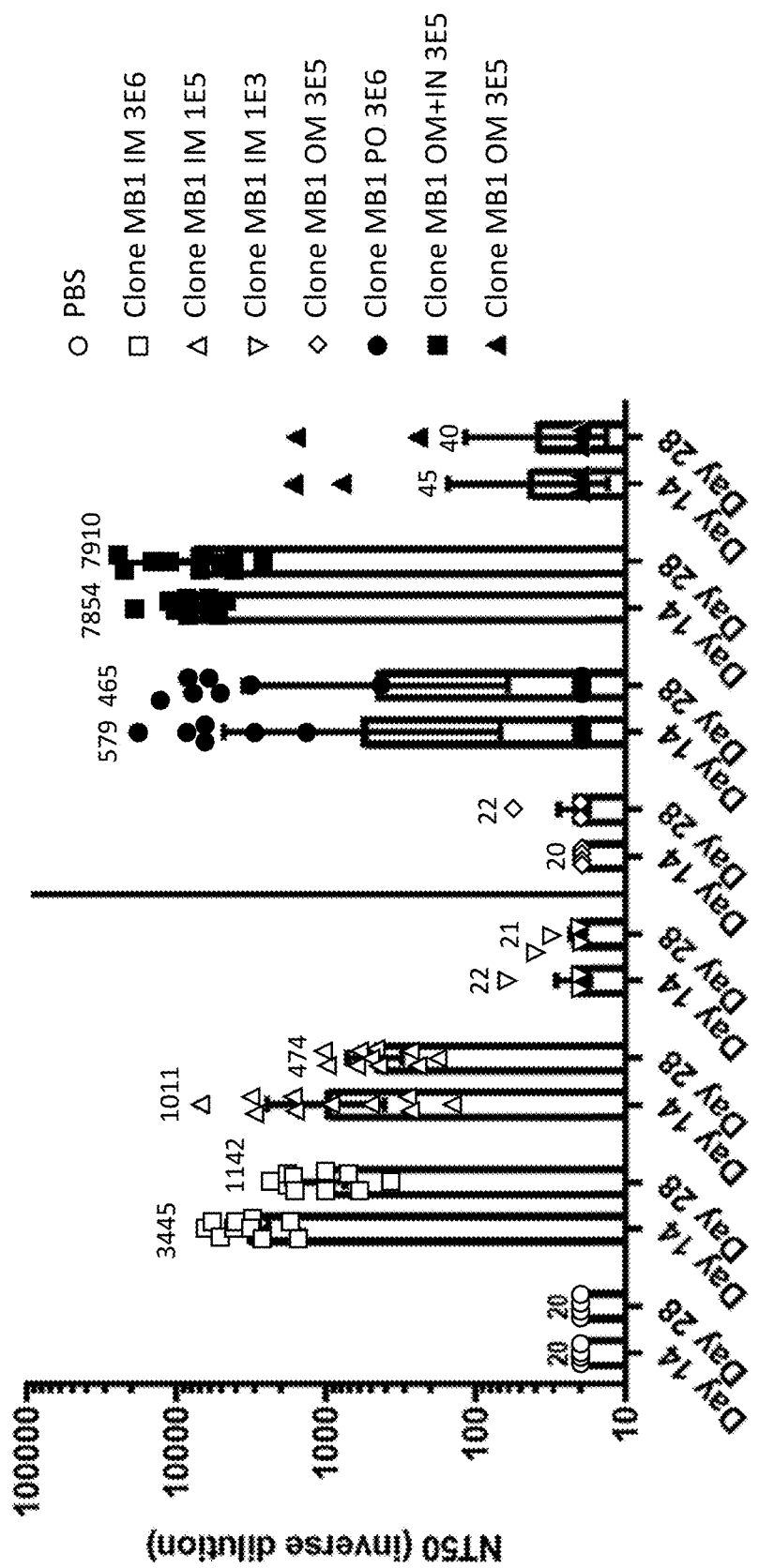
FIG. 28 shows PRNT neutralizing titers at Days 14 and 28 after vaccination.

PRNT neutralizing titers after 14 and 28 days following a single immunization are shown in FIG. 28. MB1 showed comparable immunogenicity following IM administration.

L. Assessment of Viral Load after Challenge

Figure 29B:
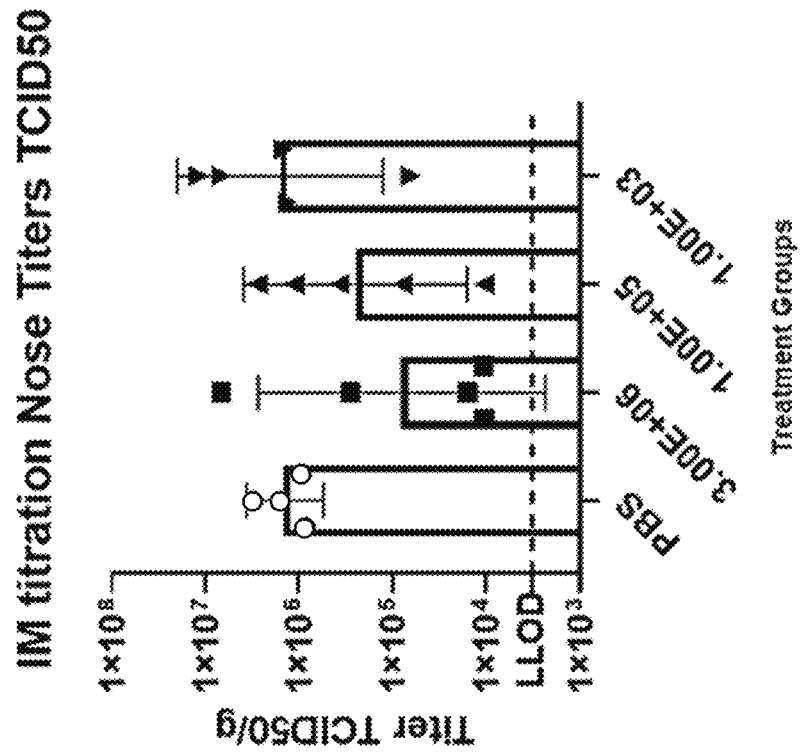
FIGS. 29A-D show viral loads as determined by $TCID_{50}$ in the lung and the nose at Day 4 after challenge.
Figure 29A:
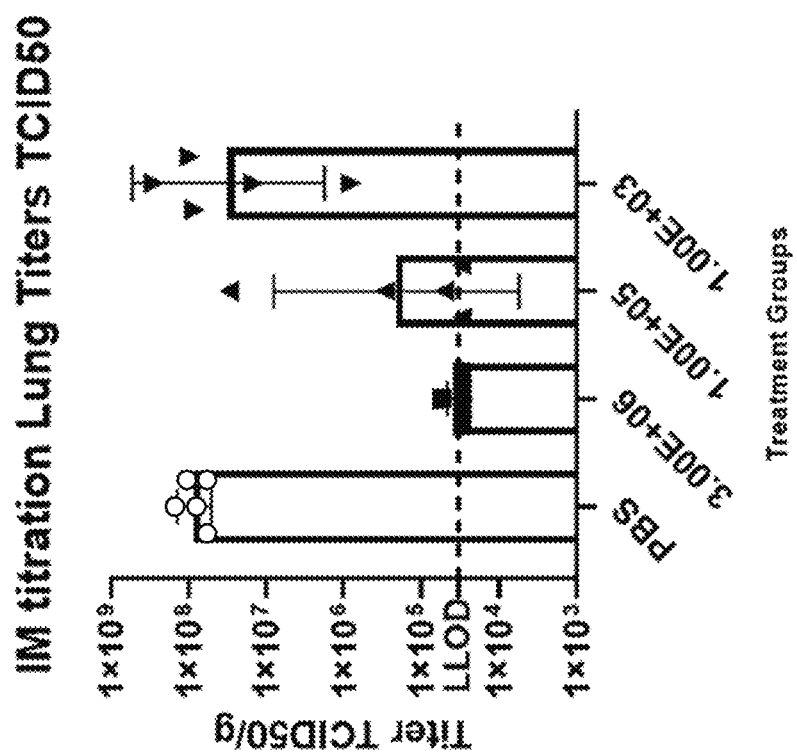
Figure 29D:
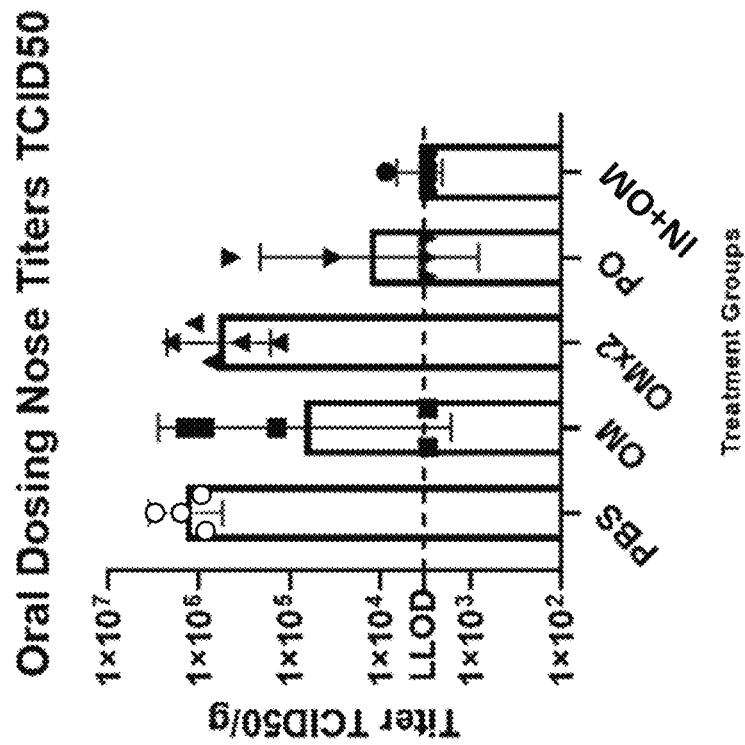
Figure 29C:
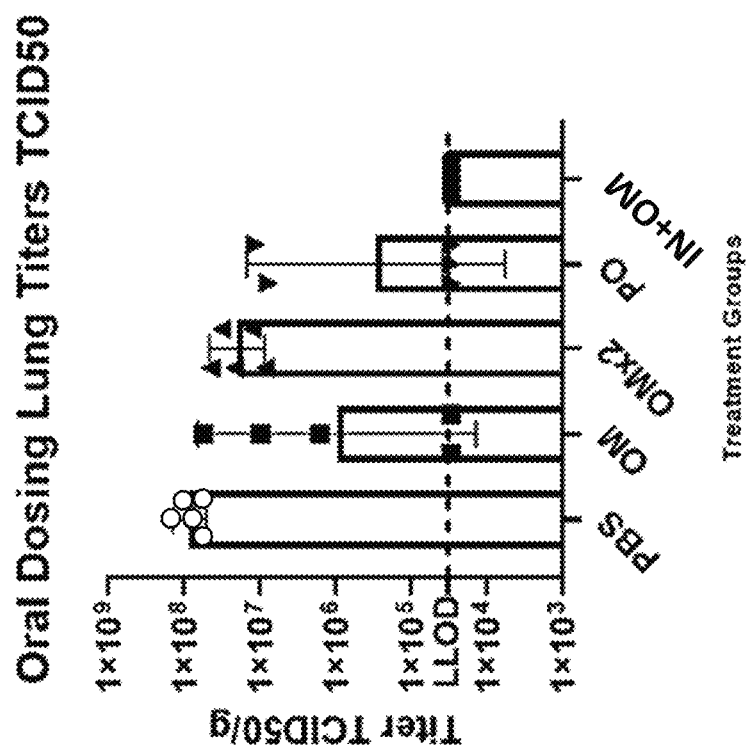

SARS-CoV-2 viral load was measured in lung and nose 4 days after challenge. Levels of replicating SARS-CoV-2 quantified by TCID$_{50}$ are shown in FIGS. 29A-D. Following IM administration, the 3×10^6 pfu dose of MB1 led to a ~3.5 log drop in SARS-CoV-2 in hamster lung (FIG. 29A) and a ~1.5 log drop in SARS-CoV-2 in the nose (FIG. 29B). The 1×10^5 pfu dose led to a smaller drop in viral titer and the 1×10^3 pfu dose of MB1 was not notably different than no vaccine (FIGS. 29A-B). Following a single OM vaccination, 2/5 animals showed no evidence of SARS-CoV-2 in nose or lung, while the remaining animals showed lower to no protection from challenge (FIGS. 29C and 29D). Following PO vaccination, 3/5 animals showed no evidence of SARS-CoV-2 in nose or lung (FIGS. 29C and 29D). Following IN+OM vaccination, 5/5 animals had no evidence of SARS-CoV-2 in lung, and 1/5 animals had a slightly higher than background level of SARS-CoV-2 in nose.

M. Conclusions

Data through Day 26 suggest immunogenicity responses were initiated post-vaccination for rVSVΔG-SARS-CoV-2 clones MB1 (nucleic acid SEQ ID NO: 150 or amino acid sequences SEQ ID NOS: 151-153, 155, and 156) by the IM, OM, PO, and IN+OM routes of administration as seen by anti-SARS-CoV-2 S protein IgG titers and SARS-CoV-2 PRNT titers.

Single-dose IM administration of rVSVΔG-SARS-CoV-2 clone MB1 protected animals from SARS-CoV-2 in lung and nose post-challenge, suggesting a protection against COVID-19.

Single-dose OM administration of rVSVΔG-SARS-CoV-2 clone MB1 provided protection from SARS-CoV-2 in lung and nose in 3/10 hamsters, suggesting there was inadequate protection against COVID-19. This aligns with the lower immunogenicity responses observed in the ELISA and PRNT assays.

Single-dose PO administration of rVSVΔG-SARS-CoV-2 clone MB1 protected 3/5 animals from SARS-CoV-2 in lung and nose post-challenge, suggesting partial protection against COVID-19. This aligns with the immunogenicity responses observed in the ELISA and PRNT assays.

Single-dose IN+OM administration of rVSVΔG-SARS-CoV-2 clone MB1 protected animals from SARS-CoV-2 in lung and nose post-challenge, suggesting a protection against COVID-19.

Example 19. Mucosal Vaccination

A. Vaccination by Applying VSVΔG-SARS-CoV-2 to the Mucosal Surfaces in the Nasal and/or Oral Cavities In preclinical studies, SARS-CoV-2 infection has been demonstrated by applying virus directly to the mucosal surfaces in the nasal or oral cavities. Lee et al., Cell Rep Med, 1:100121 (2020). Consistent with these findings, studies have shown that the ACE2 used by the SARS-CoV-2 S protein for cell attachment is expressed by cells in these mucosal tissues. Ziegler et al., Cell, 181:1016-1035 e19 (2020); Suresh et al., Frontiers in Pharmacology, 11 (2020); Xu et al., Int J Oral Sci, 12:8 (2020). The susceptibility of these mucosal tissues to SARS-CoV-2 infection suggested that vaccination with VSVΔG-SARS-CoV-2 could be conducted by applying the vaccine virus directly to mucosal surfaces in the nasal or oral cavity. Vaccination with VSVΔG-SARS-CoV-2 by these routes may be advantageous because it has the potential to induce both systemic and local mucosal barrier immunities that can prevent severe disease in the lower respiratory tract as well as reduce SARS-CoV-2 replication in the upper airways, thereby reducing the risk of virus transmission. Gallo et al., Mucosal Immunol, doi: 10.1038/s41385-020-00359-2 (2020).

To investigate the feasibility of mucosal vaccination with a VSVΔG-SARS-CoV-2 vaccine, rhesus macaques were vaccinated by three different methods (4 animals per method) using an investigational vaccine strain, Fp11, that differed from VSVΔG-SARS-CoV-2 MB1 as described in Table 18 below. In the first vaccination method, anesthetized animals were vaccinated by the intranasal route (IN) using a spray device (mucosal atomizer device; MAD™ from Teleflex Inc.) that delivered $1\times10^7$ PFUs per nostril. In the second method, virus was delivered to the oral mucosa (OM) by applying $2\times10^7$ PFUs dropwise to the top surface of the tongue of anesthetized macaques. The final method was a combination of both intranasal and oral mucosal approaches (IN+OM) with the total dose of $2\times10^7$ PFUs split equally across the two nostrils and the tongue. Vaccinations were conducted at week 0 and week 8.

TABLE 18

Mutations in MB1 and Strain Fp11

| Donor sequence | Affected amino acid position | Wild-type | MB1 | Strain Fp11 |
|---|---|---|---|---|
| SARS-CoV-2 S protein | C-terminus | No deletion | 23 amino acids deleted from the C-terminus | 21 amino acids deleted from the C-terminus |
|  | 484 | E | E | D |
|  | 655 | H | H | Y |
|  | 683 | R | G | R |
|  | 813 | S | F | S |
| VSV Matrix | 61 | Y | S | Y |
| VSV Matrix | 213 | E | E | K |

B. ELISA

Materials used for ELISA in this example are provided in Table 19.

TABLE 19

List of Materials

| Material | Vendor | Catalog no. |
|---|---|---|
| Adhesive Film for Microplates | VWR | 60941-064 |
| Costar ® assay plate, 96 well, clear, flat bottom, half-area, high-binding, polystyrene, non-sterile | Corning | 3690 |
| ELISA coating buffer (5X) | Biolegend | 421701 |
| Coating protein: SARS-CoV-2 spike protein prefusion-stabilized ectodomain, C-term His tag, with furin cleavage site removed, trimerization stabilized | Lake Pharma | 46328 |
| Secondary antibody: horseradish peroxidase (HRP) conjugated goat anti-human IgG | Jackson ImmunoResearch | 109-035-098 |
| Tween-20 | Sigma Aldrich | P9416 |
| 2N $H_2SO_4$ | Fisher Scientific | MK-H381-1 |
| DPBS, 1X without calcium and magnesium | Corning | 21-031-CV |
| 1-Step Ultra ® TMB-ELISA at room temperature | Thermo Scientific | 34029 |
| Tissue Culture Plate, 96 well, U-bottom with low evaporation lid | BD Falcon | 353227 |
| Sterile pipets | VWR |  |
| Cordless pipet-aid | Drummond |  |
| Sterile barrier pipet tips | Ranin, BioHit, Molecular Bioproducts |  |
| Pipettors | VWR, Ranin, BioHit |  |
| Distilled or reverse osmosis purified water at room temperature |  |  |
| ELISA coating buffer 1X diluted with distilled/reverse osmosis purified water | Biolegend |  |
| Plate wash buffer, PBST (1X PBS pH 7.4, 0.05% Tween-20) at room temperature |  |  |
| Blocking buffer solution (3% bovine serum albumin (BSA pH 7.4) at room temperature |  |  |
| Dilution solution (1% BSA in 1X PBS pH 7.4) at room temperature |  |  |
| Stop solution (2N $H_2SO_4$) at room temperature |  |  |
| ELx405 select deep well microplate washer | Biotek |  |
| Versa Max microplate reader and SoftMax Pro GxP data acquisition software | Molecular Devices |  |
| GraphPad Prism 9 software |  |  |

The ELISA method was used to detect anti-SARS-CoV-2 S protein-specific IgG antibodies in the serum of vaccinated animals. The protein coating used for the ELISA method was a soluble SARS-CoV-2 S protein in which the S1 and S2 subunits were covalently linked.

96 well ELISA plates were coated with 50 μL/well of SARS-CoV-2 antigen (1ug/ml) diluted in 1× coating buffer. Only half of the wells in each plate were used. Each plate was covered with microplate adhesive film and incubated overnight at 4° C. The plates were washed using a plate washer. Then, the plates were blocked with 150 μL/well of blocking buffer and incubated at 37° C. for 1 hour 30 minutes.

Meanwhile, test serum was diluted in a 96-well U-bottom plate at 1:100 using dilution solution and set aside.

Back to the blocked plates, the blocked plates were washed using a plate washer. Wells in columns 2-12 were filled with 50 μL/well of dilution solution. For incubation with serum, 75 ul of diluted serum from the U-bottom plate was transferred into each well of column 1. A 3-fold serial dilution was performed across plate from column 2 through column 11, leaving the wells in column 12 as the blank. Plates were incubated at 37° C. for 1 hours.

The serum-treated plates were washed using a plate washer. For antibody labeling, 50 μL of diluted secondary antibody (1:5,000 in dilution solution) was added to each well. The plates were incubated at 37° C. for 1 hour.

The antibody-labeled plates were washed using a plate washer. 50 μL of 1-Step Ultra® TMB was added to each well at room temperature. The incubation period was 10 mins. 50 μL of Stop Solution was added to stop development. Plates were read using a plate reader at 450 nm.

C. Results

Figure 30:
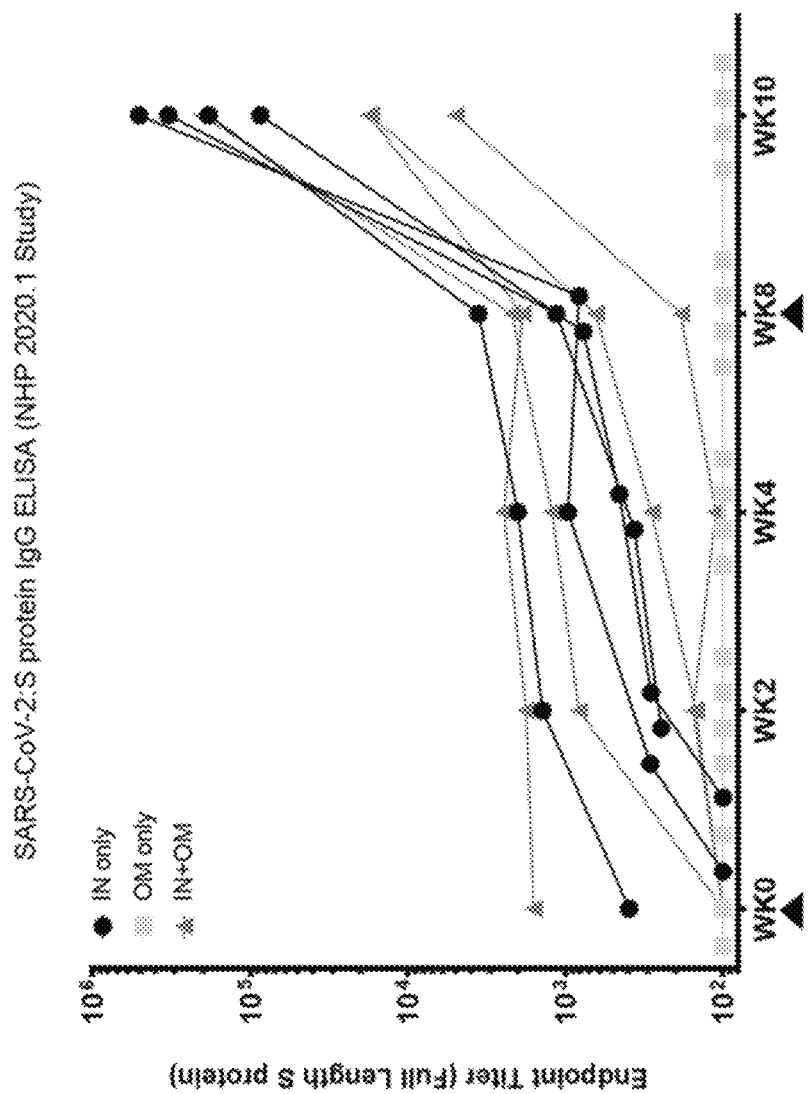
FIG. 30 shows the SARS-CoV-2 S protein IgG levels in the serum of rhesus macaques vaccinated with VSVΔG-SARS-CoV-2 strain Fp11. IN, intranasal; OM, oral mucosal; IN+OM, intranasal+oral mucosal.

As shown in FIG. 30, the study results demonstrated that most macaques vaccinated with VSVΔG-SARS-CoV-2 strain Fp11 by the IN or IN+OM method developed detectable serum antibodies against the SARS-CoV-2 S protein by week 4 and all were positive by week 8. Animals vaccinated only by the OM method did not respond. To evaluate the effect of a second vaccination, macaques were vaccinated with identical dose and method at week 8. At two weeks following the second vaccination, there was a pronounced increase in serum antibody titers in animals vaccinated by the IN or IN+OM methods indicating the initial vaccination established immunologic memory that allowed a robust recall response following the second vaccination.

Example 20. Embodiments

The following numbered items provide a description of certain embodiments herein.

Item 1. A recombinant vesicular stomatitis virus (VSV) vector, comprising a modified VSV genome, wherein the modified VSV genome comprises a foreign gene derived from a Severe Acute Respiratory Syndrome coronavirus 2 (SARS-CoV-2).

Item 2. A recombinant vesicular stomatitis virus (VSV) vector, comprising a modified VSV genome, wherein the modified VSV genome comprises a foreign gene encoding a Severe Acute Respiratory Syndrome coronavirus 2 (SARS-CoV-2) spike (S) protein or an immunogenic variant thereof.

Item 3. A recombinant vesicular stomatitis virus (VSV) vector, comprising a modified VSV genome, wherein the modified VSV genome comprises a portion of a VSV glycoprotein (G) gene and a foreign gene encoding an immunogenic variant of a Severe Acute Respiratory Syndrome coronavirus 2 (SARS-CoV-2) spike (S) protein.

Item 4. The recombinant VSV vector of any one of the preceding items, wherein the SARS-CoV-2 S protein consists of the amino acid sequence as shown in FIG. 1A or an amino acid sequence having GenBank Accession number gb_QHW06059, gb_QHZ00379, gb_QHR84449, gb_QIA20044, gb_QHZ00358, dbj_BCA25664, gb_QHZ87582, dbj_BCA25674, gb_QHZ00389, gb_QHZ87592, gb_QIB84673, gb_QHR63260, gb_QIA98606, gb_QIA98596, gb_QHR63250, gb_QHR63280, gb_QHR63290, gb_QHR63270, gb_QHZ00399, dbj_BCA25644, dbj_BCA25654, gb_QHO62877, ref_YP_00972439, gb_QHW06039, gb_QHO62112, gb_QHQ71973, gb_QHW06049, gb_QHO60594, gb_QHN73810, gb_QHO62107, gb_QHQ82464, dbj_BBW89517, gb_QHU79204, gb_QHQ71963, gb_QHU79194, gb_QHN73795, gb_QHU36864, gb_QHD43416, gb_QHU36854, gb_QHU36844, gb_QHU36834 or gb_QHU36824 as shown in FIG. 2.

Item 5. The recombinant VSV vector of any one items 1-3, wherein the immunogenic variant of the SARS-CoV-2 S protein consists of an amino acid sequence at least 90% identical to that of the SARS-CoV-2 S protein.

Item 6. The recombinant VSV vector of any one items 1-3, wherein the immunogenic variant of the SARS-CoV-2 S protein is a fragment of the SARS-CoV-2 S protein having a deletion at the C-terminal end of the SARS-CoV-2 S protein.

Item 7. The recombinant VSV vector of item 1 or 2, wherein the immunogenic variant of the SARS-CoV-2 S protein is a fragment of the SARS-CoV-2 S protein lacking a cytoplasmic tail of the SARS-CoV-2 S protein.

Item 8. The recombinant VSV vector of item 1 or 2, wherein the immunogenic variant of the SARS-CoV-2 S protein is a fragment of the SARS-CoV-2 S protein lacking a cytoplasmic tail and a transmembrane domain of the SARS-CoV-2 S protein.

Item 9. The recombinant VSV vector of any one items 1-3, wherein the immunogenic variant of the SARS-CoV-2 S protein is a fragment of the SARS-CoV-2 S protein lacking a cytoplasmic tail of the SARS-CoV-2 S protein, and wherein the portion of the VSV-G gene encodes a cytoplasmic tail of a VSV-G protein.

Item 10. The recombinant VSV vector of any one items 1-3, wherein the immunogenic variant of the SARS-CoV-2 S protein is a fragment of the SARS-CoV-2 S protein lacking a cytoplasmic tail and a transmembrane domain of the SARS-CoV-2 S protein, and wherein the portion of the VSV-G gene encodes a cytoplasmic tail and a transmembrane domain of a VSV-G protein.

Item 11. The recombinant VSV vector of any one of the preceding items, wherein the modified VSV genome further comprises a VSV nucleoprotein (N) gene, a VSV phosphoprotein (P) gene, a VSV matrixprotein (M) gene, and a VSV polymerase (L) gene arranged in sequence from 3' end to 5' end.

Item 12. The recombinant VSV vector of any one items 1-10, wherein the foreign gene is inserted on the 3' end of the VSV-N gene.

Item 13. The recombinant VSV vector of any one items 1-10, wherein the foreign gene is between the VSV-N gene and the VSV-P gene.

Item 14. The recombinant VSV vector of any one items 1-10, wherein the foreign gene is between the VSV-P gene and the VSV-M gene.

Item 15. The recombinant VSV vector of any one items 1-10, wherein the foreign gene is between the VSV-M gene and the VSV-L gene.

Item 16. The recombinant VSV vector of any one items 1-10, wherein the foreign gene is on the 5' end of the VSV-L gene.

Item 17. The recombinant VSV vector of item 1 or 2, wherein the foreign gene encodes the SARS-CoV-2 S protein, and wherein the modified VSV genome does not comprise a VSV glycoprotein (G) gene or a portion thereof.

Item 18. A recombinant replicable vesicular stomatitis virus (VSV) particle, comprising a modified VSV genome and a Severe Acute Respiratory Syndrome coronavirus 2 (SARSCoV-2) spike (S) protein or an immunogenic variant thereof on the surface of the recombinant replicable VSV particle, wherein the modified VSV genome comprises a foreign gene encoding the SARS-CoV-2 S protein or the immunogenic variant thereof.

Item 19. A recombinant replicable vesicular stomatitis virus (VSV) particle, comprising a modified VSV genome and an immunogenic variant of a Severe Acute Respiratory Syndrome coronavirus 2 (SARS-CoV-2) spike (S) protein on the surface of the recombinant replicable VSV particle, wherein the modified VSV genome comprises a portion of a VSV glycoprotein (G) gene and a foreign gene encoding the immunogenic variant of the SARSCoV-2 S protein.

Item 20. The recombinant replicable VSV particle of item 18 or 19, wherein the SARS10 CoV-2 S protein consists of the amino acid sequence as shown in FIG. 1A or an amino acid sequence having GenBank Accession number gb_QHW06059, gb_QHZ00379, gb_QHR84449, gb_QIA20044, gb_QHZ00358, dbj_BCA25664, gb_QHZ87582, dbj_BCA25674, gb_QHZ00389, gb_QHZ87592, gb_QIB84673, gb_QHR63260, gb_QIA98606, gb_QIA98596, gb_QHR63250, gb_QHR63280, gb_QHR63290, gb_QHR63270, gb_QHZ00399, dbj_BCA25644, dbj_BCA25654, gb_QHO62877, ref_YP_00972439, gb_QHW06039, gb_QHO62112, gb_QHQ71973, gb_QHW06049, gb_QHO60594, gb_QHN73810, gb_QHO62107, gb_QHQ82464, dbj_BBW89517, gb_QHU79204, gb_QHQ71963, gb_QHU79194, gb_QHN73795, gb_QHU36864, gb_QHD43416, gb_QHU36854, gb_QHU36844, gb_QHU36834 or gb_QHU36824 as shown in FIG. 2.

Item 21. The recombinant replicable VSV particle of item 18 or 19, wherein the immunogenic variant of the SARS-CoV-2 S protein consists of an amino acid sequence at least 90% identical to that of the SARS-CoV-2 S protein.

Item 22. The recombinant replicable VSV particle of item 18 or 19, wherein the immunogenic variant of the SARS-CoV-2 S protein is a fragment of the SARS-CoV-2 S protein having a deletion at the C-terminal end of the SARS-CoV-2 S protein.

Item 23. The recombinant replicable VSV particle of item 18, wherein the immunogenic variant of the SARS-CoV-2 S protein is a fragment of the SARS-CoV-2 S protein lacking a cytoplasmic tail of the SARS-CoV-2 S protein.

Item 24. The recombinant replicable VSV particle of item 18, wherein the immunogenic variant of the SARS-CoV-2 S protein is a fragment of the SARS-CoV-2 S protein lacking a cytoplasmic tail and a transmembrane domain of the SARS-CoV-2 S protein.

Item 25. The recombinant replicable VSV particle of item 18 or 19, wherein the immunogenic variant of the SARS-CoV-2 S protein is a fragment of the SARS-CoV-2 S protein lacking a cytoplasmic tail of the SARS-CoV-2 S protein, and wherein the portion of the VSV-G gene encodes a cytoplasmic tail of a VSV-G protein.

Item 26. The recombinant replicable VSV particle of item 18 or 19, wherein the immunogenic variant of the SARS-CoV-2 S protein is a fragment of the SARS-CoV-2 S protein lacking a cytoplasmic tail and a transmembrane domain of the SARS-CoV-2 S protein, and wherein the portion of the VSV-G gene encodes a cytoplasmic tail and a transmembrane domain of a VSV-G protein.

Item 27. The recombinant replicable VSV particle of any one of items 18-26, wherein the modified VSV genome further comprises a VSV nucleoprotein (N) gene, a VSV phosphoprotein (P) gene, a VSV matrixprotein (M) gene, and a VSV polymerase (L) gene arranged in sequence from 3' end to 5' end.

Item 28. The recombinant replicable VSV particle of any one of items 18-27, wherein the foreign gene is inserted on the 3' end of the VSV-N gene.

Item 29. The recombinant replicable VSV particle of any one of items 18-27, wherein the foreign gene is between the VSV-N gene and the VSV-P gene.

Item 30. The recombinant replicable VSV particle of any one of items 18-27, wherein the foreign gene is between the VSV-P gene and the VSV-M gene.

Item 31. The recombinant replicable VSV particle of any one of items 18-27, wherein the foreign gene is between the VSV-M gene and the VSV-L gene.

Item 32. The recombinant replicable VSV particle of any one of items 18-27, wherein the foreign gene is on the 5' end of the VSV-L gene.

Item 33. The recombinant replicable VSV particle of item 18, wherein the foreign gene encodes the SARS-CoV-2 S protein, and wherein the modified VSV genome does not comprise a VSV glycoprotein (G) gene or a portion thereof.

Item 34. An immunogenic recombinant protein comprising a Severe Acute Respiratory Syndrome coronavirus 2 (SARS-CoV-2) spike (S) protein or a variant thereof derived from the recombinant VSV vector of any one of items 1-17.

Item 35. An immunogenic recombinant protein comprising a variant of a Severe Acute Respiratory Syndrome coronavirus 2 (SARS-CoV-2) spike (S) protein and a portion of a VSV glycoprotein (G).

Item 36. The immunogenic recombinant protein of item 34 or 35, wherein the SARSCoV-2 S protein consists of the amino acid sequence as shown in FIG. 1A or an amino acid sequence having GenBank Accession number gb_QHW06059, gb_QHZ00379, gb_QHR84449, gb_QIA20044, gb_QHZ00358, dbj_BCA25664, gb_QHZ87582, dbj_BCA25674, gb_QHZ00389, gb_QHZ87592, gb_QIB84673, gb_QHR63260, gb_QIA98606, gb_QIA98596, gb_QHR63250, gb_QHR63280, gb_QHR63290, gb_QHR63270, gb_QHZ00399, dbj_BCA25644, dbj_BCA25654, gb_QHO62877, ref_YP_00972439, gb_QHW06039, gb_QHO62112, gb_QHQ71973, gb_QHW06049, gb_QHO60594, gb_QHN73810, gb_QHO62107, gb_QHQ82464, dbj_BBW89517, gb_QHU79204, gb_QHQ71963, gb_QHU79194, gb_QHN73795, gb_QHU36864, gb_QHD43416, gb_QHU36854, gb_QHU36844, gb_QHU36834 or gb_QHU36824 as shown in FIG. 2.

Item 37. The immunogenic recombinant protein of item 34 or 35, wherein the variant of the SARS-CoV-2 S protein consists of an amino acid sequence at least 90% identical to that of the SARS-CoV-2 S protein.

Item 38. The immunogenic recombinant protein of item 34 or 35, wherein the variant of the SARS-CoV-2 S protein is a fragment of the SARS-CoV-2 S protein having a deletion at the C-terminal end of the SARS-CoV-2 S protein.

Item 39. The immunogenic recombinant protein of item 34, wherein the variant of the SARS-CoV-2 S protein is a fragment of the SARS-CoV-2 S protein lacking a cytoplasmic tail of the SARS-CoV-2 S protein.

Item 40. The immunogenic recombinant protein of item 34, wherein the variant of the SARS-CoV-2 S protein is a fragment of the SARS-CoV-2 S protein lacking a cytoplasmic tail and a transmembrane domain of the SARS-CoV-2 S protein.

Item 41. The immunogenic recombinant protein of item 34 or 35, wherein the variant of the SARS-CoV-2 S protein is a fragment of the SARS-CoV-2 S protein lacking a cytoplasmic tail of the SARS-CoV-2 S protein, and wherein the portion of the VSV-G gene encodes a cytoplasmic tail of a VSV-G protein.

Item 42. The immunogenic recombinant protein of item 34 or 35, wherein the variant of the SARS-CoV-2 S protein is a fragment of the SARS-CoV-2 S protein lacking a cytoplasmic tail and a transmembrane domain of the SARS-CoV-2 S protein, and wherein the portion of the VSV-G gene encodes a cytoplasmic tail and a transmembrane domain of a VSV-G protein. Item 43. A recombinant nucleic acid molecule comprising a nucleotide sequence encoding a Severe Acute Respiratory Syndrome coronavirus 2 (SARS-CoV-2) spike (S) protein or a variant thereof.

Item 44. The recombinant nucleic acid molecule of item 43, wherein the nucleotide sequence is the sequence shown in FIG. 1B, 1C, 1E, 1F, 1H, 1I, 1K, 1L, 1N, 1O, IQ, 1R, 1T, 1U, 1W or 1X (SEQ ID NO: 2, 3, 5, 6, 8, 9, 11, 12, 14, 15, 17, 18, 20, 21, 23 or 24, respectively) or a nucleotide sequence encoding a SARS-CoV-2 S protein derived from the SARS-CoV-2 genome sequence having GenBank Accession Number LR757997, MT072688, MN996527, MT039873, MN938384, MT020781, MN996529, MN996530, MN996531, MT044258, LR757998, LR757996, MT066175, MT066176, LR757995, LC522972, LC522973, LC522974, LC522975, MT039887, MN988668, MN988669, MT044257, MT039888, MN997409, MN985325, MN994467, MT027062, MT027063, MT027064, MT020880, MT020881, MN988713, MT019533, MN994468, MT093571, MT019530, MT019532, MN975262, MN996528, MT007544, MT019529, MT019531, MT049951, MT039890, MN908947, NC_045512 or MT093631.

Item 45. A method for producing a recombinant replicable VSV particle, comprising (a) introducing the recombinant VSV vector of any one of items 1-17 into cells, whereby a recombinant replicable VSV particle is produced, and (b) expressing a Severe Acute Respiratory Syndrome coronavirus 2 (SARS-CoV-2) spike (S) protein or an immunogenic variant thereof on the surface of the recombinant replicable VSV particle.

Item 46. The method of item 45, wherein the cells are Vero cells.

Item 47. The method of item 45 or 46, further comprising purifying the recombinant replicable VSV particle from the cells.

Item 48. The method of item 45 or 46, further comprising purifying the SARS-CoV-2 S protein or an immunogenic variant thereof from the cells.

Item 49. The method of item 45 or 46, further comprising purifying the recombinant VSV vector from the cells.

Item 50. A recombinant cell comprising the recombinant VSV vector of any one of items 1-17 and producing a recombinant replicable VSV particle, wherein a Severe Acute Respiratory Syndrome coronavirus 2 (SARS-CoV-2) spike (S) protein or a variant thereof is expressed on the surface of the recombinant replicable VSV particle.

Item 52. A pharmaceutical composition comprising the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49.

Item 53. The pharmaceutical composition of item 52, further comprising a pharmaceutically acceptable excipient.

Item 54. The pharmaceutical composition of item 52 or 53, wherein the pharmaceutical composition is a vaccine composition.

Item 55. The pharmaceutical composition of any one of items 52-54, wherein the pharmaceutical composition is formulated for oral, sublingual, intramuscular, intradermal, subcutaneous, intranasal, intraocular, rectal, transdermal, mucosal, topical or parenteral administration.

Item 56. An oral or oral mucosal composition, comprising an effective amount of the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49.

Item 57. The oral or oral mucosal composition of item 56, wherein the oral or oral mucosal composition is formulated for buccal delivery.

Item 58. The oral or oral mucosal composition of item 56, wherein the oral or oral mucosal composition is formulated for gastrointestinal delivery.

Item 59. An intranasal composition, comprising an effective amount of the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49.

Item 60. The intranasal composition of item 59, wherein the intranasal composition is formulated for nasal mucosal delivery.

Item 61. A vaccine composition comprising the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49.

Item 62. The vaccine composition of item 61, wherein the vaccine composition is formulated for oral, sublingual, intramuscular, intradermal, subcutaneous, intranasal, intraocular, rectal, transdermal, mucosal, topical or parenteral administration.

Item 63. An oral or oral mucosal vaccine composition, comprising an effective amount of the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49.

Item 64. The oral or oral mucosal vaccine composition of item 63, wherein the oral or oral mucosal vaccine composition is formulated for buccal delivery.

Item 65. The oral or oral mucosal vaccine composition of item 63, wherein the oral or oral mucosal vaccine composition is formulated for gastrointestinal delivery.

Item 66. An intranasal vaccine composition, comprising an effective amount of the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49.

Item 67. A method of inducing an immunological response to a Severe Acute Respiratory Syndrome coronavirus 2 (SARS-CoV-2) in a subject, comprising administering to the subject an effective amount of the pharmaceutical composition of any one of items 52-55, whereby an immunological response is stimulated in the subject without causing a disease or symptom associated with the SARS-CoV-2 and the subject is vaccinated.

Item 68. The method of item 67, wherein the immunogenic response comprises a humoral response, a cellular antigen-specific immune response or a combination thereof.

Item 69. The method of item 67 or 68, wherein the immunological response comprises production of antibodies by the vaccinated subject that block SARS-CoV-2 infection, the method further comprising harvesting the antibodies from the vaccinated subject.

Item 70. The method of any one of items 67-69, wherein the antibodies are in the form of immune serum obtained from the vaccinated subject.

Item 71. The method of any one of items 67-69, wherein the antibodies are monoclonal antibodies prepared from SARS-CoV-2-specific B cells obtained from the vaccinated subject.

Item 72. The method of any one of items 69-71, further comprising mixing the harvested antibodies with a pharmaceutically acceptable excipient, whereby a pharmaceutical composition is prepared.

Item 73. A method of preventing infection of a subject by a Severe Acute Respiratory Syndrome coronavirus 2 (SARS-CoV-2), comprising administering to the subject an effective amount of the pharmaceutical composition of item 52 or 53, wherein the subject does not suffer a disease or symptom associated with the SARS-CoV-2.

Item 74. A method of vaccinating a subject against a Severe Acute Respiratory Syndrome coronavirus 2 (SARS-CoV-2), comprising administering to the subject an effective amount of the pharmaceutical composition of any one of items 52-55, wherein the subject does not suffer a disease or symptom associated with the SARS-CoV-2 and has not been exposed to the SARS-CoV-2.

Item 75. The method of any one of items 67-74, further comprising administering the pharmaceutical composition to a tissue in the subject that expresses a receptor for the SARS-CoV-2, and preventing or inhibiting binding of the SARS-CoV-2 to the receptor.

Item 76. The method of item 75, wherein the receptor is angiotensin-converting enzyme 2 (ACE2).

Item 77. The method of item 75 or 76, wherein the tissue is in the gastrointestinal (GI) tract of the subject.

Item 78. The method of any one of items 67-76, wherein the pharmaceutical composition is administered orally, sublingually, intramuscularly, intradermally, subcutaneously, intranasally, intraocularly, rectally, transdermally, mucosally, topically or parenterally.

Item 79. The method of any one of items 67-76, wherein the pharmaceutical composition is administered orally.

Item 80. The method of any one of items 67-76, wherein the pharmaceutical composition is administered intramuscularly.

Item 81. The method of any one of items 67-76, wherein the pharmaceutical composition is administered intranasally.

Item 82. A method of vaccinating a subject against a Severe Acute Respiratory Syndrome coronavirus 2 (SARS-CoV-2), comprising administering to the subject an effective amount of an oral or oral mucosal vaccine composition, wherein the oral or oral mucosal vaccine composition comprises the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49, wherein the subject does not suffer a disease or symptom associated with the SARS-CoV-2 and has not been exposed to the SARS-CoV-2.

Item 83. The method of item 82, further comprising delivering to a tissue in the subject the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARSCoV-2) spike (S) protein or a variant thereof purified according to the method of item 48, or the recombinant VSV vector purified according to the method of item 49, wherein the tissue is buccal mucosa.

Item 84. The method of item 82, further comprising delivering to a tissue in the subject the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARSCoV-2) spike (S) protein or a variant thereof purified according to the method of item 48, or the recombinant VSV vector purified according to the method of item 49, wherein the tissue is gastrointestinal mucosa.

Item 85. A method of vaccinating a subject against a Severe Acute Respiratory Syndrome coronavirus 2 (SARS-CoV-2), comprising administering to the subject an effective amount of an intranasal vaccine composition, wherein the intranasal mucosal vaccine composition comprises the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARS-CoV-2) spike (S) protein or a variant thereof purified according to the method of item 48, or the recombinant VSV vector purified according to the method of item 49, wherein the subject does not suffer a disease or symptom associated with the SARS-CoV-2 and has not been exposed to the SARS-CoV-2.

Item 86. The method of item 85, further comprising delivering to a tissue in the subject the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARSCoV-2) spike (S) protein or a variant thereof purified according to the method of item 48, or the recombinant VSV vector purified according to the method of item 49, wherein the tissue is intranasal mucosa.

Item 87. The method of item 82 or 85, further comprising delivering to a tissue in the subject the recombinant VSV vector of any one of items 1-17, the recombinant replicable VSV particle of any one of items 18-33, the immunogenic recombinant protein of any one of items 34-42, the recombinant replicable VSV particle produced according to the method of any one of items 45-49, the Severe Acute Respiratory Syndrome coronavirus 2 (SARSCoV-2) spike (S) protein or a variant thereof purified according to the method of item 48, or the recombinant VSV vector purified according to the method of item 49, wherein the tissue expresses a receptor for the SARS-CoV-2.

Item 88. The method of any one of items 82, 85, or 87, wherein the receptor is angiotensin-converting enzyme 2 (ACE2).

Item 89. The method of any one of items 82, 85, 87, or 88, further comprising preventing or inhibiting binding of the SARS-CoV-2 to the receptor after the subject is exposed to the SARS-CoV-2.

Item 90. The method of any one of items 67-89, wherein the subject is a male.

Item 91. The method of any one of items 67-89, wherein the subject is a female.

Item 92. The method of any one of items 67-91, wherein the subject has a preexisting medical condition.

Item 93. The method of item 92, wherein the pre-existing medical condition is selected from the group consisting of high blood pressure, a heart disease, diabetes, a lung disease and combinations thereof.

Item 94. The method of any one of items 67-93, wherein the pharmaceutical composition is administered in a single dose.

Item 95. The method of any one of items 67-93, wherein the pharmaceutical composition is administered in two or multiple doses.

Item 96. The method of item 95, wherein the first dose is for a priming immunization and the second dose is a boosting immunization.

Item 97. A method of producing an adaptive mutant of the recombinant replicable VSV particle of any one of items 18-33, comprising growing the recombinant replicable VSV particle in a cell culture, changing a condition of the cell culture, identifying a mutant of the recombinant replicable VSV particle exhibiting greater replication capacity than the recombinant replicable VSV particle, whereby an adaptive mutant of the recombinant replicable VSV particle is obtained.

Item 98. The method of item 97, wherein the condition is selected from the group consisting of temperature, culture medium and cell substrate.

Item 99. The method of item 97 or 98, wherein the adaptive mutant exhibits at least 50% greater replication capacity than the recombinant replicable VSV particle. All documents, books, manuals, papers, patents, published patent applications, guides, abstracts, and other references cited herein are incorporated by reference in their entirety. Other embodiments will be apparent to those skilled in the art from consideration and practice of the disclosure. It is intended that the specification and examples be considered as exemplary and embodiments should be construed in accordance with the appended claims and any equivalents thereof.

SEQUENCE LISTING (194 sequences)

SEQ ID NO: 1 - protein, 1273 aa, Artificial Sequence
  Synthetic: Construct 1: wt S protein amino acid sequence
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2 - DNA, 3846 bp, Artificial Sequence
  Synthetic: Construct 1: nucleotide sequence of wt S protein to be added to Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgcaagttcgatgaggatgattcagaaccagttttaaaaggagtaaagttgcattacacataaaggctagc

SEQ ID NO: 3 - DNA, 3987 bp, Artificial Sequence
  Synthetic: Construct 1: nucleotide sequence of wt S protein to be added to Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgcaagttcgatgaggatgattcagaaccagttttaaaaggagtaaagttgcattacacataaagctcaaatcctgcacaacagattcttcatgtttgaaccaaatcaacttgtgatatcatgctcaaagaggccttaattaa

SEQ ID NO: 4 - protein, 1242 aa, Artificial Sequence
  Synthetic: Construct 2: S protein with CT deletion
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCS

SEQ ID NO: 5 - DNA, 3753 bp, Artificial Sequence
  Synthetic: Construct 2: nucleotide sequence of S protein with CT deletion to be added to Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcataaaggctagc

SEQ ID NO: 6 - DNA, 3894 bp, Artificial Sequence
  Synthetic: Construct 2: nucleotide sequence of S protein with CT deletion to be added to Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcataaagctcaaatcctgcacaacagattcttcatgtttgaaccaaatcaacttgtgatatcatgctcaaagaggccttaattaa

SEQ ID NO: 7 - protein, 1263 aa, Artificial Sequence
  Synthetic: Construct 3: S protein with VSVG-CT IND serotype
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLRVGIYLCIKLKHTKKRQIYTDIEMNRLGK

SEQ ID NO: 8 - DNA, 3816 bp, Artificial Sequence
  Synthetic: Construct 3: nucleotide sequence of S protein with VSVG-CT IND serotype to be added to Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgcgagttggtatttatctttgcattaaattaaagcacaccaagaaaagacagatttatacagacatagagatgaaccgacttggaaagtaaaggctagc

SEQ ID NO: 9 - DNA, 3957 bp, Artificial Sequence
  Synthetic: Construct 3: nucleotide sequence of S protein with VSVG-CT IND serotype to Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgcgagttggtatttatctttgcattaaattaaagcacaccaagaaaagacagatttatacagacatagagatgaaccgacttggaaagtaaagctcaaatcctgcacaacagattcttcatgtttgaaccaaatcaacttgtgatatcatgctcaaagaggccttaattaa

SEQ ID NO: 10 - protein, 1266 aa, Artificial Sequence
  Synthetic: Construct 4: S protein with VSVG-TM-CT IND serotype
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWSSIASFFFIIGLIIGLFLVLRVGIYLCIKLKHTKKRQIYTDIEMNRLGK

SEQ ID NO: 11 - DNA, 3825 bp, Artificial Sequence
  Synthetic: Construct 4: nucleotide sequence of S protein with VSVG-TM-CT IND serotype to be added to Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggagctctattgcctcttttttctttatcatagggttaatcattggactattcttggttctccgagttggtatttatctttgcattaaattaaagcacaccaagaaaagacagatttatacagacatagagatgaaccgacttggaaagtaaaggctagc

SEQ ID NO: 12 - DNA, 3966 bp, Artificial Sequence
  Synthetic: Construct 4: nucleotide sequence of S protein with VSVG-TM-CT IND serotype to be added to Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggagctctattgcctcttttttctttatcatagggttaatcattggactattcttggttctccgagttggtatttatctttgcattaaattaaagcacaccaagaaaagacagatttatacagacatagagatgaaccgacttggaaagtaaagctcaaatcctgcacaacagattcttcatgtttgaaccaaatcaacttgtgatatcatgctcaaagaggccttaattaa

SEQ ID NO: 13 - protein, 1260 aa, Artificial Sequence
  Synthetic: Construct 5: S protein with MPER6aa and VSVG-TM-CT IND serotype
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKSSIASFFFIIGLIIGLFLVLRVGIYLCIKLKHTKKRQIYTDIEMNRLGK

SEQ ID NO: 14 - DNA, 3807 bp, Artificial Sequence
  Synthetic: Construct 5: nucleotide sequence of S protein with MPER6aa and VSVG-TM-CT IND serotype
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaaagctctattgcctcttttttctttatcatagggttaatcattggactattcttggttctccgagttggtatttatctttgcattaaattaaagcacaccaagaaaagacagatttatacagacatagagatgaaccgacttggaaagtaaaggctagc

SEQ ID NO: 15 - DNA, 3948 bp, Artificial Sequence
  Synthetic: Construct 5: nucleotide sequence of S protein with MPER6aa and VSVG-TM-CT IND serotype
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaaagctctattgcctcttttttctttatcatagggttaatcattggactattcttggttctccgagttggtatttatctttgcattaaattaaagcacaccaagaaaagacagatttatacagacatagagatgaaccgacttggaaagtaaagctcaaatcctgcacaacagattcttcatgtttgaaccaaatcaacttgtgatatcatgctcaaagaggccttaattaa

SEQ ID NO: 16 - protein, 1252 aa, Artificial Sequence
  Synthetic: Construct 6: S protein with dCt21
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGS

SEQ ID NO: 17 - DNA, 3783 bp, Artificial Sequence
  Synthetic: Construct 6: Nucleotide sequence of S protein with dCt21 to be added Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttaaaggctagc

SEQ ID NO: 18 - DNA, 3924 bp, Artificial Sequence
  Synthetic: Construct 6: Nucleotide sequence of S protein with dCt21 to be added Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttaaagctcaaatcctgcacaacagattcttcatgtttgaaccaaatcaacttgtgatatcatgctcaaagaggccttaattaa

SEQ ID NO: 19 - protein, 1283 aa, Artificial Sequence
  Synthetic: Construct 7: S protein with dCt19 and VSVGct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCRVGIYLCIKLKHTKKRQIYTDIEMNRLGK

SEQ ID NO: 20 - DNA, 3876 bp, Artificial Sequence
  Synthetic: Construct 7: Nucleotide sequence of S protein with dCt19 and VSGct to be added Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgccgagttggtatttatctttgcattaaattaaagcacaccaagaaaagacagatttatacagacatagagatgaaccgacttggaaagtaaaggctagc

SEQ ID NO: 21 - DNA, 4017 bp, Artificial Sequence
  Synthetic: Construct 7: Nucleotide sequence of S protein with dCt19 and VSGct to be added Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgccgagttggtatttatctttgcattaaattaaagcacaccaagaaaagacagatttatacagacatagagatgaaccgacttggaaagtaaagctcaaatcctgcacaacagattcttcatgtttgaaccaaatcaacttgtgatatcatgctcaaagaggccttaattaa

SEQ ID NO: 22 - protein, 1275 aa, Artificial Sequence
  Synthetic: Construct 8: S protein with dCt19 and VSVGct21
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKLKHTKKRQIYTDIEMNRLGK

SEQ ID NO: 23 - DNA, 3852 bp, Artificial Sequence
  Synthetic: Construct 8: Nucleotide sequence of S protein with dCt19 and VSGct21 to be added Vector A
ctcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgcaaattaaagcacaccaagaaaagacagatttatacagacatagagatgaaccgacttggaaagtaaaggctagc

SEQ ID NO: 24 - DNA, 3993 bp, Artificial Sequence
  Synthetic: Construct 8: Nucleotide sequence of S protein with dCt19 and VSGct21 to be added Vector B
ttcgaacaactaatatcctgtcttctctatccctatgaaaaaaactaacagagatcgatctgtttccttgacaccaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgcaaattaaagcacaccaagaaaagacagatttatacagacatagagatgaaccgacttggaaagtaaagctcaaatcctgcacaacagattcttcatgtttgaaccaaatcaacttgtgatatcatgctcaaagaggccttaattaa

SEQ ID NO: 25 - protein, 1273 aa, Severe acute respiratory syndrome coronavirus 2
  SITE (1)..(1273): gb_QHW06059 (a full-length SARS-CoV-2 S protein amino acid variant sequence)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 26 - protein, 1273 aa, Severe acute respiratory syndrome coronavirus 2
  SITE (1)..(1273): gb_QHZ00379 (a full-length SARS-CoV-2 S protein amino acid variant sequence)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27 - protein, 1273 aa, Severe acute respiratory syndrome coronavirus 2
  SITE (1)..(1273): gb_QHR84449 (a full-length SARS-CoV-2 S protein amino acid variant sequence)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28 - protein, 1273 aa, Severe acute respiratory syndrome coronavirus 2
  SITE (1)..(1273): gb_QIA20044 (a full-length SARS-CoV-2 S protein amino acid variant sequence)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 29 - protein, 1273 aa, Severe acute respiratory syndrome coronavirus 2; identical to SEQ ID NO: 1
  SITE (1)..(1273): gb_QHZ00358 (a full-length SARS-CoV-2 S protein amino acid variant sequence)

SEQ ID NO: 30 - protein, 1273 aa, Severe acute respiratory syndrome coronavirus 2; identical to SEQ ID NO: 1
  SITE (1)..(1273): dbj_BCA25664 (a full-length SARS-CoV-2 S protein amino acid variant sequence)

SEQ ID NO: 31 - protein, 1273 aa, Severe acute respiratory syndrome coronavirus 2; identical to SEQ ID NO: 1
  SITE (1)..(1273): gb_QHZ87582 (a full-length SARS-CoV-2 S protein amino acid variant sequence)

SEQ ID NO: 32 - protein, 1273 aa, Severe acute respiratory syndrome coronavirus 2; identical to SEQ ID NO: 1
  SITE (1)..(1273): dbj_BCA25674 (a full-length SARS-CoV-2 S protein amino acid variant sequence)

SEQ ID NO: 33 - protein, 1273 aa, Severe acute respiratory syndrome coronavirus 2; identical to SEQ ID NO: 1
  SITE (1)..(1273): gb_QHZ00389 (a full-length SARS-CoV-2 S protein amino acid variant sequence)

SEQ ID NO: 34 - protein, 1273 aa, Severe acute respiratory syndrome coronavirus 2; identical to SEQ ID NO: 1
  SITE (1)..(1273): gb_QHZ87592 (a full-length SARS-CoV-2 S protein amino acid variant sequence)

SEQ ID NO: 35 - protein, 1273 aa, Severe acute respiratory syndrome coronavirus 2; identical to SEQ ID NO: 1
  SITE (1)..(1273): gb_QIB84673 (a full-length SARS-CoV-2 S protein amino acid variant sequence)

SEQ ID NO: 36 - protein, 1273 aa, Severe acute respiratory syndrome coronavirus 2; identical to SEQ ID NO: 1
  SITE (1)..(1273): gb_QHR63260 (a full-length SARS-CoV-2 S protein amino acid variant sequence)

SEQ ID NO: 37 - protein, 1273 aa, Severe acute respiratory syndrome coronavirus 2; identical to SEQ ID NO: 1
  SITE (1)..(1273): gb_QIA98606 (a full-length SARS-CoV-2 S protein amino acid variant sequence)

SEQ ID NO: 38 - protein, 1273 aa, Severe acute respiratory syndrome coronavirus 2; identical to SEQ ID NO: 1
  SITE (1)..(1273): gb_QIA98596 (a full-length SARS-CoV-2 S protein amino acid variant sequence)

SEQ ID NO: 39 - protein, 1273 aa, Severe acute respiratory syndrome coronavirus 2; identical to SEQ ID NO: 1
  SITE (1)..(1273): gb_QHR63250 (a full-length SARS-CoV-2 S protein amino acid variant sequence)

SEQ ID NO: 40 - protein, 1273 aa, Severe acute respiratory syndrome coronavirus 2; identical to SEQ ID NO: 1
  SITE (1)..(1273): gb_QHR63280 (a full-length SARS-CoV-2 S protein amino acid variant sequence)

SEQ ID NO: 41 - protein, 1273 aa, Severe acute respiratory syndrome coronavirus 2; identical to SEQ ID NO: 1
  SITE (1)..(1273): gb_QHR63290 (a full-length SARS-CoV-2 S protein amino acid variant sequence)

SEQ ID NO: 42 - protein, 1273 aa, Severe acute respiratory syndrome coronavirus 2; identical to SEQ ID NO: 1
  SITE (1)..(1273): gb_QHR63270 (a full-length SARS-CoV-2 S protein amino acid variant sequence)

SEQ ID NO: 43 - protein, 1273 aa, Severe acute respiratory syndrome coronavirus 2; identical to SEQ ID NO: 1
  SITE (1)..(1273): gb_QHZ00399 (a full-length SARS-CoV-2 S protein amino acid variant sequence)

SEQ ID NO: 44 - protein, 1273 aa, Severe acute respiratory syndrome coronavirus 2; identical to SEQ ID NO: 1
  SITE (1)..(1273): dbj_BCA25644 (a full-length SARS-CoV-2 S protein amino acid variant sequence)

SEQ ID NO: 45 - protein, 1273 aa, Severe acute respiratory syndrome coronavirus 2; identical to SEQ ID NO: 1
  SITE (1)..(1273): dbj_BCA25654 (a full-length SARS-CoV-2 S protein amino acid variant sequence)

SEQ ID NO: 46 - protein, 1273 aa, Severe acute respiratory syndrome coronavirus 2; identical to SEQ ID NO: 1
  SITE (1)..(1273): gb_QHO62877 (a full-length SARS-CoV-2 S protein amino acid variant sequence)

SEQ ID NO: 47 - protein, 1273 aa, Severe acute respiratory syndrome coronavirus 2; identical to SEQ ID NO: 1
  SITE (1)..(1273): ref_YP_00972439 (a full-length SARS-CoV-2 S protein amino acid variant sequence)

SEQ ID NO: 48 - protein, 1273 aa, Severe acute respiratory syndrome coronavirus 2; identical to SEQ ID NO: 1
  SITE (1)..(1273): gb_QHW06039 (a full-length SARS-CoV-2 S protein amino acid variant sequence)

SEQ ID NO: 49 - protein, 1273 aa, Severe acute respiratory syndrome coronavirus 2; identical to SEQ ID NO: 1
  SITE (1)..(1273): gb_QHO62112 (a full-length SARS-CoV-2 S protein amino acid variant sequence)

SEQ ID NO: 50 - protein, 1273 aa, Severe acute respiratory syndrome coronavirus 2; identical to SEQ ID NO: 1
  SITE (1)..(1273): gb_QHQ71973 (a full-length SARS-CoV-2 S protein amino acid variant sequence)

SEQ ID NO: 51 - protein, 1273 aa, Severe acute respiratory syndrome coronavirus 2; identical to SEQ ID NO: 1
  SITE (1)..(1273): gb_QHW06049 (a full-length SARS-CoV-2 S protein amino acid variant sequence)

SEQ ID NO: 52 - protein, 1273 aa, Severe acute respiratory syndrome coronavirus 2; identical to SEQ ID NO: 1
  SITE (1)..(1273): gb_QHO60594 (a full-length SARS-CoV-2 S protein amino acid variant sequence)

SEQ ID NO: 53 - protein, 1273 aa, Severe acute respiratory syndrome coronavirus 2; identical to SEQ ID NO: 1
  SITE (1)..(1273): gb_QHN73810 (a full-length SARS-CoV-2 S protein amino acid variant sequence)

SEQ ID NO: 54 - protein, 1273 aa, Severe acute respiratory syndrome coronavirus 2; identical to SEQ ID NO: 1
  SITE (1)..(1273): gb_QHO62107 (a full-length SARS-CoV-2 S protein amino acid variant sequence)

SEQ ID NO: 55 - protein, 1273 aa, Severe acute respiratory syndrome coronavirus 2; identical to SEQ ID NO: 1
  SITE (1)..(1273): gb_QHQ82464 (a full-length SARS-CoV-2 S protein amino acid variant sequence)

SEQ ID NO: 56 - protein, 1273 aa, Severe acute respiratory syndrome coronavirus 2; identical to SEQ ID NO: 1
  SITE (1)..(1273): dbj_BBW89517 (a full-length SARS-CoV-2 S protein amino acid variant sequence)

SEQ ID NO: 57 - protein, 1273 aa, Severe acute respiratory syndrome coronavirus 2; identical to SEQ ID NO: 1
  SITE (1)..(1273): gb_QHU79204 (a full-length SARS-CoV-2 S protein amino acid variant sequence)

SEQ ID NO: 58 - protein, 1273 aa, Severe acute respiratory syndrome coronavirus 2; identical to SEQ ID NO: 1
  SITE (1)..(1273): gb_QHQ71963 (a full-length SARS-CoV-2 S protein amino acid variant sequence)

SEQ ID NO: 59 - protein, 1273 aa, Severe acute respiratory syndrome coronavirus 2; identical to SEQ ID NO: 1
  SITE (1)..(1273): gb_QHU79194 (a full-length SARS-CoV-2 S protein amino acid variant sequence)

SEQ ID NO: 60 - protein, 1273 aa, Severe acute respiratory syndrome coronavirus 2; identical to SEQ ID NO: 1
  SITE (1)..(1273): gb_QHN73795 (a full-length SARS-CoV-2 S protein amino acid variant sequence)

SEQ ID NO: 61 - protein, 1273 aa, Severe acute respiratory syndrome coronavirus 2; identical to SEQ ID NO: 1
  SITE (1)..(1273): gb_QHU36864 (a full-length SARS-CoV-2 S protein amino acid variant sequence)

SEQ ID NO: 62 - protein, 1273 aa, Severe acute respiratory syndrome coronavirus 2; identical to SEQ ID NO: 1
  SITE (1)..(1273): gb_QHD43416 (a full-length SARS-CoV-2 S protein amino acid variant sequence)

SEQ ID NO: 63 - protein, 1273 aa, Severe acute respiratory syndrome coronavirus 2; identical to SEQ ID NO: 1
  SITE (1)..(1273): gb_QHU36854 (a full-length SARS-CoV-2 S protein amino acid variant sequence)

SEQ ID NO: 64 - protein, 1273 aa, Severe acute respiratory syndrome coronavirus 2; identical to SEQ ID NO: 1
  SITE (1)..(1273): gb_QHU36844 (a full-length SARS-CoV-2 S protein amino acid variant sequence)

SEQ ID NO: 65 - protein, 1273 aa, Severe acute respiratory syndrome coronavirus 2; identical to SEQ ID NO: 1
  SITE (1)..(1273): gb_QHU36834 (a full-length SARS-CoV-2 S protein amino acid variant sequence)

SEQ ID NO: 66 - protein, 1273 aa, Severe acute respiratory syndrome coronavirus 2; identical to SEQ ID NO: 1
  SITE (1)..(1273): gb_QHU36824 (a full-length SARS-CoV-2 S protein amino acid variant sequence)

SEQ ID NO: 67 - protein, 1273 aa, Severe acute respiratory syndrome coronavirus 2; identical to SEQ ID NO: 1
  SITE (1)..(1273): Consensus sequence

SEQ ID NO: 68 - DNA, 35 bp, Artificial Sequence
  Synthetic: 1gVSVLeader_f (primer used for the Sanger sequencing of the rVSV-delta-G-SARS-CoV-2 genome)
acgaagacaaacaaaccattattatcattaaaagg

SEQ ID NO: 69 - DNA, 22 bp, Artificial Sequence
  Synthetic: 2gVSV_400f (primer used for the Sanger sequencing of the rVSV-delta-G-SARS-CoV-2 genome)
agcaggggatacaatcggaata

SEQ ID NO: 70 - DNA, 22 bp, Artificial Sequence
  Synthetic: 3gVSV_800f
cacctctgcaaaataaccggaa

SEQ ID NO: 71 - DNA, 21 bp, Artificial Sequence
  Synthetic: 4gVSV_1200f
gcagagatgtggtcgaatggc

SEQ ID NO: 72 - DNA, 20 bp, Artificial Sequence
  Synthetic: 5gVSV_1600f
tgaaggctttatacaggggc

SEQ ID NO: 73 - DNA, 20 bp, Artificial Sequence
  Synthetic: 6gVSV_200r
tggtagacatatcctcttag

SEQ ID NO: 74 - DNA, 20 bp, Artificial Sequence
  Synthetic: 7gVSV_400r
gctggttctggaagcatccg

SEQ ID NO: 75 - DNA, 24 bp, Artificial Sequence
  Synthetic: 8gVSV_800r
ctggaagcatcatttggaccattt

SEQ ID NO: 76 - DNA, 24 bp, Artificial Sequence
  Synthetic: 9gVSV_1200r
gctcttttcgcatactgcatcata

SEQ ID NO: 77 - DNA, 24 bp, Artificial Sequence
  Synthetic: 10gVSV_1600r
ccacttcctcatctgcatagtcat

SEQ ID NO: 78 - DNA, 21 bp, Artificial Sequence
  Synthetic: 11gVSV_1200f
gcagagatgtggtcgaatggc

SEQ ID NO: 79 - DNA, 20 bp, Artificial Sequence
  Synthetic: 12gVSV_1600f
tgaaggctttatacaggggc

SEQ ID NO: 80 - DNA, 22 bp, Artificial Sequence
  Synthetic: 13gVSV_2000f
tccatgactttccaacccaaga

SEQ ID NO: 81 - DNA, 24 bp, Artificial Sequence
  Synthetic: 14gVSV_2400f
cgagatggacacctatgatccgaa

SEQ ID NO: 82 - DNA, 24 bp, Artificial Sequence
  Synthetic: 15gVSV_1200r
gctcttttcgcatactgcatcata

SEQ ID NO: 83 - DNA, 24 bp, Artificial Sequence
  Synthetic: 16gVSV_1600r
ccacttcctcatctgcatagtcat

SEQ ID NO: 84 - DNA, 24 bp, Artificial Sequence
  Synthetic: 17gVSV_2000r
ctccgacagagatgaactctcctc

SEQ ID NO: 85 - DNA, 24 bp, Artificial Sequence
  Synthetic: 18gVSV_2400r
gctgccacatctgagtatgttctg

SEQ ID NO: 86 - DNA, 22 bp, Artificial Sequence
  Synthetic: 19gVSV_2000f
tccatgactttccaacccaaga

SEQ ID NO: 87 - DNA, 24 bp, Artificial Sequence
  Synthetic: 20gVSV_2400f
cgagatggacacctatgatccgaa

SEQ ID NO: 88 - DNA, 20 bp, Artificial Sequence
  Synthetic: 21gVSV_2800f2
ctacgatgatgagtcactgg

SEQ ID NO: 89 - DNA, 24 bp, Artificial Sequence
  Synthetic: 22gVSV_2400r
gctgccacatctgagtatgttctg

SEQ ID NO: 90 - DNA, 22 bp, Artificial Sequence
  Synthetic: 23gVSV_2800r
cctttttctcgacaatcaggcc

SEQ ID NO: 91 - DNA, 20 bp, Artificial Sequence
  Synthetic: 24CoV_S_rvs1
ctctttgttccattggttcc

SEQ ID NO: 92 - DNA, 24 bp, Artificial Sequence
  Synthetic: 25gVSV_2400f
cgagatggacacctatgatccgaa

SEQ ID NO: 93 - DNA, 20 bp, Artificial Sequence
  Synthetic: 26CoV_S_fw1
agtggatcctactcgagagg

SEQ ID NO: 94 - DNA, 20 bp, Artificial Sequence
  Synthetic: 27CoV_S_fw2
cattaaagtctgtgaattcc

SEQ ID NO: 95 - DNA, 20 bp, Artificial Sequence
  Synthetic: 28CoV_S_fw3
agcagctgcttactatgttg

SEQ ID NO: 96 - DNA, 20 bp, Artificial Sequence
  Synthetic: 29CoV_S_fw4
gtatatgcagattcctttgt

SEQ ID NO: 97 - DNA, 21 bp, Artificial Sequence
  Synthetic: 30CoV_S_fw5
acctaagaagagcactaatct

SEQ ID NO: 98 - DNA, 20 bp, Artificial Sequence
  Synthetic: 31CoV_S_rvs1
ctctttgttccattggttcc

SEQ ID NO: 99 - DNA, 25 bp, Artificial Sequence
  Synthetic: 32CoV_S_rvs2
gatctctaactaggtttataggtgt

SEQ ID NO: 100 - DNA, 20 bp, Artificial Sequence
  Synthetic: 33CoV_S_rvs3
agtagcattgaaaacctctc

SEQ ID NO: 101 - DNA, 20 bp, Artificial Sequence
  Synthetic: 34CoV_S_rvs4
cattacacggtgtgctgccc

SEQ ID NO: 102 - DNA, 20 bp, Artificial Sequence
  Synthetic: 35CoV_S_rvs5
gatagagaacggcaacttga

SEQ ID NO: 103 - DNA, 20 bp, Artificial Sequence
  Synthetic: 36CoV_S_rvs6
ggaatctccacagatgtaca

SEQ ID NO: 104 - DNA, 21 bp, Artificial Sequence
  Synthetic: 37CoV_S_fw5
acctaagaagagcactaatct

SEQ ID NO: 105 - DNA, 20 bp, Artificial Sequence
  Synthetic: 38CoV_S_fw6
tgacattccaatcggtgccg

SEQ ID NO: 106 - DNA, 25 bp, Artificial Sequence
  Synthetic: 39CoV_S_fw7
ccatcaaggattttggaggatttaa

SEQ ID NO: 107 - DNA, 20 bp, Artificial Sequence
  Synthetic: 40CoV_S_fw8
gctataggaaagattcagga

SEQ ID NO: 108 - DNA, 20 bp, Artificial Sequence
  Synthetic: 41CoV_S_fw9
acatgtaacatatgtgcccg

SEQ ID NO: 109 - DNA, 20 bp, Artificial Sequence
  Synthetic: 42CoV_S_fw10
tgatcgaccttcaggagctg

SEQ ID NO: 110 - DNA, 20 bp, Artificial Sequence
  Synthetic: 43CoV_S_rvs7
tgtaattgtaccagccaaca

SEQ ID NO: 111 - DNA, 20 bp, Artificial Sequence
  Synthetic: 44CoV_S_rvs8
tgatgagttgttgggtgacg

SEQ ID NO: 112 - DNA, 20 bp, Artificial Sequence
  Synthetic: 45CoV_S_rvs9
ggaatcgagttcaggttgta

SEQ ID NO: 113 - DNA, 20 bp, Artificial Sequence
  Synthetic: 46CoV_S_rvs10
aacgcgtaaacagctagcct

SEQ ID NO: 114 - DNA, 25 bp, Artificial Sequence
  Synthetic: 47gVSVGene4_f
ttaatgtttggcctgattgtcgaga

SEQ ID NO: 115 - DNA, 21 bp, Artificial Sequence
  Synthetic: 48gVSVGene4_rev
gcgctcatcgggattcaggaa

SEQ ID NO: 116 - DNA, 22 bp, Artificial Sequence
  Synthetic: 49gVSV_4800r
ccaccacgtcaaatgttatttc

SEQ ID NO: 117 - DNA, 20 bp, Artificial Sequence
  Synthetic: 50CoV_S_fw10
acatgtaacatatgtgcccg

SEQ ID NO: 118 - DNA, 20 bp, Artificial Sequence
  Synthetic: 51gVSV_5300f
gggcaacaaaccaattgaat

SEQ ID NO: 119 - DNA, 23 bp, Artificial Sequence
  Synthetic: 52gVSV_5800f
gcaagagaatcaaggcctttagt

SEQ ID NO: 120 - DNA, 25 bp, Artificial Sequence
  Synthetic: 53gVSV_6300f
cccatcgataatatactctgacaaa

SEQ ID NO: 121 - DNA, 24 bp, Artificial Sequence
  Synthetic: 54gVSV_6800f
tccttaatcgagagaactcatgaa

SEQ ID NO: 122 - DNA, 22 bp, Artificial Sequence
  Synthetic: 55gVSV_4800r
ccaccacgtcaaatgttatttc

SEQ ID NO: 123 - DNA, 23 bp, Artificial Sequence
  Synthetic: 56gVSV_5200r2
actaaaggccttgattctcttgc

SEQ ID NO: 124 - DNA, 24 bp, Artificial Sequence
  Synthetic: 57gVSV_5200r
gatgggtctagtaagtcgggtatt

SEQ ID NO: 125 - DNA, 24 bp, Artificial Sequence
  Synthetic: 58gVSV_6200r2
ttcatgagttctctcgattaagga

SEQ ID NO: 126 - DNA, 20 bp, Artificial Sequence
  Synthetic: 59gVSV_6200r
cactcgtgaccatctcttgg

SEQ ID NO: 127 - DNA, 25 bp, Artificial Sequence
  Synthetic: 60gVSV_6300f
cccatcgataatatactctgacaaa

SEQ ID NO: 128 - DNA, 24 bp, Artificial Sequence
  Synthetic: 61gVSV_6800f
tccttaatcgagagaactcatgaa

SEQ ID NO: 129 - DNA, 21 bp, Artificial Sequence
  Synthetic: 62gVSV_7300f
tgaccaaatacccacttgtgc

SEQ ID NO: 130 - DNA, 25 bp, Artificial Sequence
  Synthetic: 63gVSV_7800f
cgaacttgttaaagactgaggttaa

SEQ ID NO: 131 - DNA, 20 bp, Artificial Sequence
  Synthetic: 64JKgVSV_8300f
cgggatccatgacgtcttta

SEQ ID NO: 132 - DNA, 24 bp, Artificial Sequence
  Synthetic: 65gVSV_8800f
tttgagacccatagaagagatcac

SEQ ID NO: 133 - DNA, 20 bp, Artificial Sequence
  Synthetic: 66gVSV_6200r
cactcgtgaccatctcttgg

SEQ ID NO: 134 - DNA, 25 bp, Artificial Sequence
  Synthetic: 67gVSV_7200r2
ttaacctcagtctttaacaagttcg

SEQ ID NO: 135 - DNA, 22 bp, Artificial Sequence
  Synthetic: 68gVSV_7200r
tgaaccctgatgtgttacatgg

SEQ ID NO: 136 - DNA, 24 bp, Artificial Sequence
  Synthetic: 69gVSV_8200r2
gtgatctcttctatgggtctcaaa

SEQ ID NO: 137 - DNA, 25 bp, Artificial Sequence
  Synthetic: 70gVSV_8200r
tcgtttctaattcgtctctaatagg

SEQ ID NO: 138 - DNA, 20 bp, Artificial Sequence
  Synthetic: 71gVSV_8300f
cgggatccatgacgtcttta

SEQ ID NO: 139 - DNA, 24 bp, Artificial Sequence
  Synthetic: 72gVSV_8800f
tttgagacccatagaagagatcac

SEQ ID NO: 140 - DNA, 20 bp, Artificial Sequence
  Synthetic: 73gVSV_9300f
ctcctatccgacaagcaacc

SEQ ID NO: 141 - DNA, 20 bp, Artificial Sequence
  Synthetic: 74gVSV_9800f
gaatcaggttgggccaatta

SEQ ID NO: 142 - DNA, 22 bp, Artificial Sequence
  Synthetic: 75gVSV_10300f
gagcgaaaagaatgcagtaaca

SEQ ID NO: 143 - DNA, 20 bp, Artificial Sequence
  Synthetic: 76gVSV_10800f
gcttttggctgagtttgatg

SEQ ID NO: 144 - DNA, 20 bp, Artificial Sequence
  Synthetic: 77JKVSVGene6_f
aaacacaggaatgattgaat

SEQ ID NO: 145 - DNA, 25 bp, Artificial Sequence
  Synthetic: 78gVSV_8200r
tcgtttctaattcgtctctaatagg

SEQ ID NO: 146 - DNA, 20 bp, Artificial Sequence
  Synthetic: 79gVSV_9200r2
taattggcccaacctgattc

SEQ ID NO: 147 - DNA, 25 bp, Artificial Sequence
  Synthetic: 80gVSV_9200r
cgctctcacaaatatatgttccata

SEQ ID NO: 148 - DNA, 20 bp, Artificial Sequence
  Synthetic: 81gVSV_10200r2
catcaaactcagccaaaagc

SEQ ID NO: 149 - DNA, 24 bp, Artificial Sequence
  Synthetic: 82JRVSVTrailer_r
acgaagaccacaaaaccagataaa

SEQ ID NO: 150 - DNA, 13440 bp, Artificial Sequence
  Synthetic: Nucleotide sequence for rVSV-delta-G-SARS-CoV-2 clone MB1
acgaagacaaacaaaccattattatcattaaaaggctcaggagaaactttaacagtaatcaaaatgtctgttacagtcaagagaatcattgacaacacagtcgtagttccaaaacttcctgcaaatgaggatccagtggaatacccggcagattacttcagaaaatcaaaggagattcctctttacatcaatactacaaaaagtttgtcagatctaagaggatatgtctaccaaggcctcaaatccggaaatgtatcaatcatacatgtcaacagctacttgtatggagcattaaaggacatccggggtaagttggataaagattggtcaagtttcggaataaacatcgggaaagcaggggatacaatcggaatatttgaccttgtatccttgaaagccctggacggcgtacttccagatggagtatcggatgcttccagaaccagcgcagatgacaaatggttgcctttgtatctacttggcttatacagagtgggcagaacacaaatgcctgaatacagaaaaaagctcatggatgggctgacaaatcaatgcaaaatgatcaatgaacagtttgaacctcttgtgccagaaggtcgtgacatttttgatgtgtggggaaatgacagtaattacacaaaaattgtcgctgcagtggacatgttcttccacatgttcaaaaaacatgaatgtgcctcgttcagatacggaactattgtttccagattcaaagattgtgctgcattggcaacatttggacacctctgcaaaataaccggaatgtctacagaagatgtaacgacctggatcttgaaccgagaagttgcagatgaaatggtccaaatgatgcttccaggccaagaaattgacaaggccgattcatacatgccttatttgatcgactttggattgtcttctaagtctccatattcttccgtcaaaaaccctgccttccacttctgggggcaattgacagctcttctgctcagatccaccagagcaaggaatgcccgacagcctgatgacattgagtatacatctcttactacagcaggtttgttgtacgcttatgcagtaggatcctctgccgacttggcacaacagttttgtgttggagataacaaatacactccagatgatagtaccggaggattgacgactaatgcaccgccacaaggcagagatgtggtcgaatggctcggatggtttgaagatcaaaacagaaaaccgactcctgatatgatgcagtatgcgaaaagagcagtcatgtcactgcaaggcctaagagagaagacaattggcaagtatgctaagtcagaatttgacaaatgaccctataattctcagatcacctattatatattatgctacatatgaaaaaaactaacagatatcatggataatctcacaaaagttcgtgagtatctcaagtcctattctcgtctggatcaggcggtaggagagatagatgagatcgaagcacaacgagctgaaaagtccaattatgagttgttccaagaggatggagtggaagagcatactaagccctcttattttcaggcagcagatgattctgacacagaatctgaaccagaaattgaagacaatcaaggcttgtatgcaccagatccagaagctgagcaagttgaaggctttatacaggggcctttagatgactatgcagatgaggaagtggatgttgtatttacttcggactggaaacagcctgagcttgaatctgacgagcatggaaagaccttacggttgacatcgccagagggtttaagtggagagcagaaatcccagtggctttcgacgattaaagcagtcgtgcaaagtgccaaatactggaatctggcagagtgcacatttgaagcatcgggagaaggggtcattatgaaggagcgccagataactccggatgtatataaggtcactccagtgatgaacacacatccgtcccaatcagaagcagtatcagatgtttggtctctctcaaagacatccatgactttccaacccaagaaagcaagtcttcagcctctcaccatatccttggatgaattgttctcatctagaggagagttcatctctgtcggaggtgacggacgaatgtctcataaagaggccatcctgctcggcctgagatacaaaaagttgtacaatcaggcgagagtcaaatattctctgtagactatgaaaaaaagtaacagatatcacgatctaagtgttatcccaatccattcatcatgagttccttaaagaagattctcggtctgaaggggaaaggtaagaaatctaagaaattagggatcgcaccacccccttatgaagaggacactagcatggagtatgctccgagcgctccaattgacaaatcctattttggagttgacgagatggacacctatgatccgaatcaattaagatctgagaaattcttctttacagtgaaaatgacggttagatctaatcgtccgttcagaacatactcagatgtggcagccgctgtatcccattgggatcacatgtacatcggaatggcagggaaacgtcccttctacaaaatcttggcttttttgggttcttctaatctaaaggccactccagcggtattggcagatcaaggtcaaccagagtatcacgctcactgcgaaggcagggcttatttgccacataggatggggaagacccctcccatgctcaatgtaccagagcacttcagaagaccattcaatataggtctttacaagggaacgattgagctcacaatgaccatctacgatgatgagtcactggaagcagctcctatgatctgggatcatttcaattcttccaaattttctgatttcagagagaaggccttaatgtttggcctgattgtcgagaaaaaggcatctggagcgtgggtcctggactctatcggccacttcaaatgagctagtctaacttctagcttctgaacaatccccggtttactcagtctcccctaattccagcctctcgaacaactaatatcctgtcttttctatccctatgaaaaaaactaacagagattgatctgtttacgcgctagtggatcctactcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaggagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagcccttcaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgttgatcttgttgcaagttcgatgaggatgattcagaaccagttttaaaaggagtaaagttgcattacacataaaggctagctgtttacgcgttatccatgctcaaagaggcctcaattatatttgagtttttaatttttatgaaaaaaactaacagcaatcatggaagtccacgattttgagaccgacgagttcaatgatttcaatgaagatgactatgccacaagagaattcctgaatcccgatgagcgcatgacgtacttgaatcatgctgattacaacctgaattctcctctaattagtgatgatattgacaatttaatcaggaaattcaattctcttccaattccctcgatgtgggatagtaagaactgggatggagttcttgagatgttaacgtcatgtcaagccaatcccatcccaacatctcagatgcataaatggatgggaagttggttaatgtctgataatcatgatgccagtcaagggtatagttttttacatgaagtggacaaagaggcagaaataacatttgacgtggtggagaccttcatccgcggctggggcaacaaaccaattgaatacatcaaaaaggaaagatggactgactcattcaaaattctcgcttatttgtgtcaaaagtttttggacttacacaagttgacattaatcttaaatgctgtctctgaggtggaattgctcaacttggcgaggactttcaaaggcaaagtcagaagaagttctcatggaacgaacatatgcaggattagggttcccagcttgggtcctacttttatttcagaaggatgggcttacttcaagaaacttgatattctaatggaccgaaactttctgttaatggtcaaagatgtgattatagggaggatgcaaacggtgctatccatggtatgtagaatagacaacctgttctcagagcaagacatcttctcccttctaaatatctacagaattggagataaaattgtggagaggcagggaaatttttcttatgacttgattaaaatggtggaaccgatatgcaacttgaagctgatgaaattagcaagagaatcaaggcctttagtcccacaattccctcattttgaaaatcatatcaagacttctgttgatgaaggggcaaaaattgaccgaggtataagattcctccatgatcagataatgagtgtgaaaacagtggatctcacactggtgatttatggatcgttcagacattggggtcatccttttatagattattacactggactagaaaaattacattcccaagtaaccatgaagaaagatattgatgtgtcatatgcaaaagcacttgcaagtgatttagctcggattgttctatttcaacagttcaatgatcataaaaagtggttcgtgaatggagacttgctccctcatgatcatccctttaaaagtcatgttaaagaaaatacatggcccacagctgctcaagttcaagattttggagataaatggcatgaacttccgctgattaaatgttttgaaatacccgacttactagacccatcgataatatactctgacaaaagtcattcaatgaataggtcagaggtgttgaaacatgtccgaatgaatccgaacactcctatccctagtaaaaaggtgttgcagactatgttggacacaaaggctaccaattggaaagaatttcttaaagagattgatgagaagggcttagatgatgatgatctaattattggtcttaaaggaaaggagagggaactgaagttggcaggtagatttttctccctaatgtcttggaaattgcgagaatactttgtaattaccgaatatttgataaagactcatttcgtccctatgtttaaaggcctgacaatggcggacgatctaactgcagtcattaaaaagatgttagattcctcatccggccaaggattgaagtcatatgaggcaatttgcatagccaatcacattgattacgaaaaatggaataaccaccaaaggaagttatcaaacggcccagtgttccgagttatgggccagttcttaggttatccatccttaatcgagagaactcatgaattttttgagaaaagtcttatatactacaatggaagaccagacttgatgcgtgttcacaacaacacactgatcaattcaacctcccaacgagtttgttggcaaggacaagagggtggactggaaggtctacggcaaaaaggatggagtatcctcaatctactggttattcaaagagaggctaaaatcagaaacactgctgtcaaagtcttggcacaaggtgataatcaagttatttgcacacagtataaaacgaagaaatcgagaaacgttgtagaattacagggtgctctcaatcaaatggtttctaataatgagaaaattatgactgcaatcaaaatagggacagggaagttaggacttttgataaatgacgatgagactatgcaatctgcagattacttgaattatggaaaaataccgattttccgtggagtgattagagggttagagaccaagagatggtcacgagtgacttgtgtcaccaatgaccaaatacccacttgtgctaatataatgagctcagtttccacaaatgctctcaccgtagctcattttgctgagaacccaatcaatgccatgatacagtacaattattttgggacatttgctagactcttgttgatgatgcatgatcctgctcttcgtcaatcattgtatgaagttcaagataagataccaggcttgcacagttctactttcaaatacgccatgttgtatttggacccttccattggaggagtgtcgggcatgtctttgtccaggtttttgattagagccttcccagatcccgtaacagaaagtctctcattctggagattcatccatgtacatgctcgaagtgagcatctgaaggagatgagtgcagtatttggaaaccccgagatagccaagtttcgaataactcacatagacaagctagtagaagatccaacctctctgaacatcgctatgggaatgagtccagcgaacttgttaaagactgaggttaaaaaatgcttaatcgaatcaagacaaaccatcaggaaccaggtgattaaggatgcaaccatatatttgtatcatgaagaggatcggctcagaagtttcttatggtcaataaatcctctgttccctagatttttaagtgaattcaaatcaggcacttttttgggagtcgcagacgggctcatcagtctatttcaaaattctcgtactattcggaactcctttaagaaaaagtatcatagggaattggatgatttgattgtgaggagtgaggtatcctctttgacacatttagggaaacttcatttgagaaggggatcatgtaaaatgtggacatgttcagctactcatgctgacacattaagatacaaatcctggggccgtacagttattgggacaactgtaccccatccattagaaatgttgggtccacaacatcgaaaagagactccttgtgcaccatgtaacacatcagggttcaattatgtttctgtgcattgtccagacgggatccatgacgtctttagttcacggggaccattgcctgcttatctagggtctaaaacatctgaatctacatctattttgcagccttgggaaagggaaagcaaagtcccactgattaaaagagctacacgtcttagagatgctatctcttggtttgttgaacccgactctaaactagcaatgactatactttctaacatccactctttaacaggcgaagaatggaccaaaaggcagcatgggttcaaaagaacagggtctgcccttcataggttttcgacatctcggatgagccatggtgggttcgcatctcagagcactgcagcattgaccaggttgatggcaactacagacaccatgagggatctgggagatcagaatttcgactttttattccaagcaacgttgctctatgctcaaattaccaccactgttgcaagagacggatggatcaccagttgtacagatcattatcatattgcctgtaagtcctgtttgagacccatagaagagatcaccctggactcaagtatggactacacgcccccagatgtatcccatgtgctgaagacatggaggaatggggaaggttcgtggggacaagagataaaacagatctatcctttagaagggaattggaagaatttagcacctgctgagcaatcctatcaagtcggcagatgtataggttttctatatggagacttggcgtatagaaaatctactcatgccgaggacagttctctatttcctctatctatacaaggtcgtattagaggtcgaggtttcttaaaagggttgctagacggattaatgagagcaagttgctgccaagtaatacaccggagaagtctggctcatttgaagaggccggccaacgcagtgtacggaggtttgatttacttgattgataaattgagtgtatcacctccattcctttctcttactagatcaggacctattagagacgaattagaaacgattccccacaagatcccaacctcctatccgacaagcaaccgtgatatgggggtgattgtcagaaattacttcaaataccaatgccgtctaattgaaaagggaaaatacagatcacattattcacaattatggttattctcagatgtcttatccatagacttcattggaccattctctatttccaccaccctcttgcaaatcctatacaagccatttttatctgggaaagataagaatgagttgagagagctggcaaatctttcttcattgctaagatcaggagaggggtgggaagacatacatgtgaaattcttcaccaaggacatattattgtgtccagaggaaatcagacatgcttgcaagttcgggattgctaaggataataataaagacatgagctatcccccttggggaagggaatccagagggacaattacaacaatccctgtttattatacgaccaccccttacccaaagatgctagagatgcctccaagaatccaaaatcccctgctgtccggaatcaggttgggccaattaccaactggcgctcattataaaattcggagtatattacatggaatgggaatccattacagggacttcttgagttgtggagacggctccggagggatgactgctgcattactacgagaaaatgtgcatagcagaggaatattcaatagtctgttagaattatcagggtcagtcatgcgaggcgcctctcctgagccccccagtgccctagaaactttaggaggagataaatcgagatgtgtaaatggtgaaacatgttgggaatatccatctgacttatgtgacccaaggacttgggactatttcctccgactcaaagcaggcttggggcttcaaattgatttaattgtaatggatatggaagttcgggattcttctactagcctgaaaattgagacgaatgttagaaattatgtgcaccggattttggatgagcaaggagttttaatctacaagacttatggaacatatatttgtgagagcgaaaagaatgcagtaacaatccttggtcccatgttcaagacggtcgacttagttcaaacagaatttagtagttctcaaacgtctgaagtatatatggtatgtaaaggtttgaagaaattaatcgatgaacccaatcccgattggtcttccatcaatgaatcctggaaaaacctgtacgcattccagtcatcagaacaggaatttgccagagcaaagaaggttagtacatactttaccttgacaggtattccctcccaattcattcctgatccttttgtaaacattgagactatgctacaaatattcggagtacccacgggtgtgtctcatgcggctgccttaaaatcatctgatagacctgcagatttattgaccattagccttttttatatggcgattatatcgtattataacatcaatcatatcagagtaggaccgatacctccgaaccccccatcagatggaattgcacaaaatgtggggatcgctataactggtataagcttttggctgagtttgatggagaaagacattccactatatcaacagtgtttagcagttatccagcaatcattcccgattaggtgggaggctgtttcagtaaaaggaggatacaagcagaagtggagtactagaggtgatgggctcccaaaagatacccgaatttcagactccttggccccaatcgggaactggatcagatctctggaattggtccgaaaccaagttcgtctaaatccattcaatgagatcttgttcaatcagctatgtcgtacagtggataatcatttgaaatggtcaaatttgcgaagaaacacaggaatgattgaatggatcaatagacgaatttcaaaagaagaccggtctatactgatgttgaagagtgacctacacgaggaaaactcttggagagattaaaaaatcatgaggagactccaaactttaagtatgaaaaaaactttgatccttaagaccctcttgtggtttttattttttatctggttttgtggtcttcgt

SEQ ID NO: 151 - protein, 229 aa, Artificial Sequence
  Synthetic: Amino acid sequence for VSV-M protein in rVSV-delta-G-SARS-CoV-2 clone MB1
MSSLKKILGLKGKGKKSKKLGIAPPPYEEDTSMEYAPSAPIDKSYFGVDEMDTYDPNQLRSEKFFFTVKMTVRSNRPFRTYSDVAAAVSHWDHMYIGMAGKRPFYKILAFLGSSNLKATPAVLADQGQPEYHAHCEGRAYLPHRMGKTPPMLNVPEHFRRPFNIGLYKGTIELTMTIYDDESLEAAPMIWDHFNSSKFSDFREKALMFGLIVEKKASGAWVLDSIGHFK

SEQ ID NO: 152 - protein, 2109 aa, Artificial Sequence
  Synthetic: Amino acid sequence for VSV-L protein in rVSV-delta-G-SARS-CoV-2 clone MB1, MB2, and Vectors A and B
MEVHDFETDEFNDFNEDDYATREFLNPDERMTYLNHADYNLNSPLISDDIDNLIRKFNSLPIPSMWDSKNWDGVLEMLTSCQANPIPTSQMHKWMGSWLMSDNHDASQGYSFLHEVDKEAEITFDVVETFIRGWGNKPIEYIKKERWTDSFKILAYLCQKFLDLHKLTLILNAVSEVELLNLARTFKGKVRRSSHGTNICRIRVPSLGPTFISEGWAYFKKLDILMDRNFLLMVKDVIIGRMQTVLSMVCRIDNLFSEQDIFSLLNIYRIGDKIVERQGNFSYDLIKMVEPICNLKLMKLARESRPLVPQFPHFENHIKTSVDEGAKIDRGIRFLHDQIMSVKTVDLTLVIYGSFRHWGHPFIDYYTGLEKLHSQVTMKKDIDVSYAKALASDLARIVLFQQFNDHKKWFVNGDLLPHDHPFKSHVKENTWPTAAQVQDFGDKWHELPLIKCFEIPDLLDPSIIYSDKSHSMNRSEVLKHVRMNPNTPIPSKKVLQTMLDTKATNWKEFLKEIDEKGLDDDDLIIGLKGKERELKLAGRFFSLMSWKLREYFVITEYLIKTHFVPMFKGLTMADDLTAVIKKMLDSSSGQGLKSYEAICIANHIDYEKWNNHQRKLSNGPVFRVMGQFLGYPSLIERTHEFFEKSLIYYNGRPDLMRVHNNTLINSTSQRVCWQGQEGGLEGLRQKGWSILNLLVIQREAKIRNTAVKVLAQGDNQVICTQYKTKKSRNVVELQGALNQMVSNNEKIMTAIKIGTGKLGLLINDDETMQSADYLNYGKIPIFRGVIRGLETKRWSRVTCVTNDQIPTCANIMSSVSTNALTVAHFAENPINAMIQYNYFGTFARLLLMMHDPALRQSLYEVQDKIPGLHSSTFKYAMLYLDPSIGGVSGMSLSRFLIRAFPDPVTESLSFWRFIHVHARSEHLKEMSAVFGNPEIAKFRITHIDKLVEDPTSLNIAMGMSPANLLKTEVKKCLIESRQTIRNQVIKDATIYLYHEEDRLRSFLWSINPLFPRFLSEFKSGTFLGVADGLISLFQNSRTIRNSFKKKYHRELDDLIVRSEVSSLTHLGKLHLRRGSCKMWTCSATHADTLRYKSWGRTVIGTTVPHPLEMLGPQHRKETPCAPCNTSGFNYVSVHCPDGIHDVFSSRGPLPAYLGSKTSESTSILQPWERESKVPLIKRATRLRDAISWFVEPDSKLAMTILSNIHSLTGEEWTKRQHGFKRTGSALHRFSTSRMSHGGFASQSTAALTRLMATTDTMRDLGDQNFDFLFQATLLYAQITTTVARDGWITSCTDHYHIACKSCLRPIEEITLDSSMDYTPPDVSHVLKTWRNGEGSWGQEIKQIYPLEGNWKNLAPAEQSYQVGRCIGFLYGDLAYRKSTHAEDSSLFPLSIQGRIRGRGFLKGLLDGLMRASCCQVIHRRSLAHLKRPANAVYGGLIYLIDKLSVSPPFLSLTRSGPIRDELETIPHKIPTSYPTSNRDMGVIVRNYFKYQCRLIEKGKYRSHYSQLWLFSDVLSIDFIGPFSISTTLLQILYKPFLSGKDKNELRELANLSSLLRSGEGWEDIHVKFFTKDILLCPEEIRHACKFGIAKDNNKDMSYPPWGRESRGTITTIPVYYTTTPYPKMLEMPPRIQNPLLSGIRLGQLPTGAHYKIRSILHGMGIHYRDFLSCGDGSGGMTAALLRENVHSRGIFNSLLELSGSVMRGASPEPPSALETLGGDKSRCVNGETCWEYPSDLCDPRTWDYFLRLKAGLGLQIDLIVMDMEVRDSSTSLKIETNVRNYVHRILDEQGVLIYKTYGTYICESEKNAVTILGPMFKTVDLVQTEFSSSQTSEVYMVCKGLKKLIDEPNPDWSSINESWKNLYAFQSSEQEFARAKKVSTYFTLTGIPSQFIPDPFVNIETMLQIFGVPTGVSHAAALKSSDRPADLLTISLFYMAIISYYNINHIRVGPIPPNPPSDGIAQNVGIAITGISFWLSLMEKDIPLYQQCLAVIQQSFPIRWEAVSVKGGYKQKWSTRGDGLPKDTRISDSLAPIGNWIRSLELVRNQVRLNPFNEILFNQLCRTVDNHLKWSNLRRNTGMIEWINRRISKEDRSILMLKSDLHEENSWRD

SEQ ID NO: 153 - protein, 1250 aa, Artificial Sequence
  Synthetic: Amino acid sequence for SARS-CoV-2 S protein in rVSV-delta-G-SARS-CoV-2 clone MB1
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRGARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPFKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSC

SEQ ID NO: 154 - DNA, 13440 bp, Artificial Sequence
  Synthetic: Nucleotide sequence for rVSV-delta-G-SARS-CoV-2 clone MB2
acgaagacaaacaaaccattattatcattaaaaggctcaggagaaactttaacagtaatcaaaatgtctgttacagtcaagagaatcattgacaacacagtcgtagttccaaaacttcctgcaaatgaggatccagtggaatacccggcagattacttcagaaaatcaaaggagattcctctttacatcaatactacaaaaagtttgtcagatctaagaggatatgtctaccaaggcctcaaatccggaaatgtatcaatcatacatgtcaacagctacttgtatggagcattaaaggacatccggggtaagttggataaagattggtcaagtttcggaataaacatcgggaaagcaggggatacaatcggaatatttgaccttgtatccttgaaagccctggacggcgtacttccagatggagtatcggatgcttccagaaccagcgcagatgacaaatggttgcctttgtatctacttggcttatacagagtgggcagaacacaaatgcctgaatacagaaaaaagctcatggatgggctgacaaatcaatgcaaaatgatcaatgaacagtttgaacctcttgtgccagaaggtcgtgacatttttgatgtgtggggaaatgacagtaattacacaaaaattgtcgctgcagtggacatgttcttccacatgttcaaaaaacatgaatgtgcctcgttcagatacggaactattgtttccagattcaaagattgtgctgcattggcaacatttggacacctctgcaaaataaccggaatgtctacagaagatgtaacgacctggatcttgaaccgagaagttgcagatgaaatggtccaaatgatgcttccaggccaagaaattgacaaggccgattcatacatgccttatttgatcgactttggattgtcttctaagtctccatattcttccgtcaaaaaccctgccttccacttctgggggcaattgacagctcttctgctcagatccaccagagcaaggaatgcccgacagcctgatgacattgagtatacatctcttactacagcaggtttgttgtacgcttatgcagtaggatcctctgccgacttggcacaacagttttgtgttggagataacaaatacactccagatgatagtaccggaggattgacgactaatgcaccgccacaaggcagagatgtggtcgaatggctcggatggtttgaagatcaaaacagaaaaccgactcctgatatgatgcagtatgcgaaaagagcagtcatgtcactgcaaggcctaagagagaagacaattggcaagtatgctaagtcagaatttgacaaatgaccctataattctcagatcacctattatatattatgctacatatgaaaaaaactaacagatatcatggataatctcacaaaagttcgtgagtatctcaagtcctattctcgtctggatcaggcggtaggagagatagatgagatcgaagcacaacgagctgaaaagtccaattatgagttgttccaagaggatggagtggaagagcatactaagccctcttattttcaggcagcagatgattctgacacagaatctgaaccagaaattgaagacaatcaaggcttgtatgcaccagatccagaagctgagcaagttgaaggctttatacaggggcctttagatgactatgcagatgaggaagtggatgttgtatttacttcggactggaaacagcctgagcttgaatctgacgagcatggaaagaccttacggttgacatcgccagagggtttaagtggagagcagaaatcccagtggctttcgacgattaaagcagtcgtgcaaagtgccaaatactggaatctggcagagtgcacatttgaagcatcgggagaaggggtcattatgaaggagcgccagataactccggatgtatataaggtcactccagtgatgaacacacatccgtcccaatcagaagcagtatcagatgtttggtctctctcaaagacatccatgactttccaacccaagaaagcaagtcttcagcctctcaccatatccttggatgaattgttctcatctagaggagagttcatctctgtcggaggtgacggacgaatgtctcataaagaggccatcctgctcggcctgagatacaaaaagttgtacaatcaggcgagagtcaaatattctctgtagactatgaaaaaaagtaacagatatcacgatctaagtgttatcccaatccattcatcatgagttccttaaagaagattctcggtctgaaggggaaaggtaagaaatctaagaaattagggatcgcaccacccccttatgaagaggacactagcatggagtatgctccgagcgctccaattgacaaatcctattttggagttgacgagatggacacctatgatccgaatcaattaagatatgagaaattcttctttacagtgaaaatgacggttagatctaatcgtccgttcagaacatactcagatgtggcagccgctgtatcccattgggatcacatgtacatcggaatggcagggaaacgtcccttctacaaaatcttggcttttttgggttcttctaatctaaaggccactccagcggtattggcagatcaaggtcaaccagagtatcacgctcactgcgaaggcagggcttatttgccacataggatggggaagacccctcccatgctcaatgtaccagagcacttcagaagaccattcaatataggtctttacaagggaacgattgagctcacaatgaccatctacgatgatgagtcactggaagcagctcctatgatctgggatcatttcaattcttccaaattttctgatttcagagagaaggccttaatgtttggcctgattgtcgagaaaaaggcatctggagcgtgggtcctggactctatcggccacttcaaatgagctagtctaacttctagcttctgaacaatccccggtttactcagtctcccctaattccagcctctcgaacaactaatatcctgtcttttctatccctatgaaaaaaactaacagagatcgatctgtttacgcgctagtggatcctactcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaatatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgttgatcttgttgcaagttcgatgaggatgattcagaaccagttttaaaaggagtaaagttgcattacacataaaggctagctgtttacgcgttatccatgctcaaagaggcctcaattatatttgagtttttaatttttatgaaaaaaactaacagcaatcatggaagtccacgattttgagaccgacgagttcaatgatttcaatgaagatgactatgccacaagagaattcctgaatcccgatgagcgcatgacgtacttgaatcatgctgattacaacctgaattctcctctaattagtgatgatattgacaatttaatcaggaaattcaattctcttccaattccctcgatgtgggatagtaagaactgggatggagttcttgagatgttaacgtcatgtcaagccaatcccatcccaacatctcagatgcataaatggatgggaagttggttaatgtctgataatcatgatgccagtcaagggtatagttttttacatgaagtggacaaagaggcagaaataacatttgacgtggtggagaccttcatccgcggctggggcaacaaaccaattgaatacatcaaaaaggaaagatggactgactcattcaaaattctcgcttatttgtgtcaaaagtttttggacttacacaagttgacattaatcttaaatgctgtctctgaggtggaattgctcaacttggcgaggactttcaaaggcaaagtcagaagaagttctcatggaacgaacatatgcaggattagggttcccagcttgggtcctacttttatttcagaaggatgggcttacttcaagaaacttgatattctaatggaccgaaactttctgttaatggtcaaagatgtgattatagggaggatgcaaacggtgctatccatggtatgtagaatagacaacctgttctcagagcaagacatcttctcccttctaaatatctacagaattggagataaaattgtggagaggcagggaaatttttcttatgacttgattaaaatggtggaaccgatatgcaacttgaagctgatgaaattagcaagagaatcaaggcctttagtcccacaattccctcattttgaaaatcatatcaagacttctgttgatgaaggggcaaaaattgaccgaggtataagattcctccatgatcagataatgagtgtgaaaacagtggatctcacactggtgatttatggatcgttcagacattggggtcatccttttatagattattacactggactagaaaaattacattcccaagtaaccatgaagaaagatattgatgtgtcatatgcaaaagcacttgcaagtgatttagctcggattgttctatttcaacagttcaatgatcataaaaagtggttcgtgaatggagacttgctccctcatgatcatccctttaaaagtcatgttaaagaaaatacatggcccacagctgctcaagttcaagattttggagataaatggcatgaacttccgctgattaaatgttttgaaatacccgacttactagacccatcgataatatactctgacaaaagtcattcaatgaataggtcagaggtgttgaaacatgtccgaatgaatccgaacactcctatccctagtaaaaaggtgttgcagactatgttggacacaaaggctaccaattggaaagaatttcttaaagagattgatgagaagggcttagatgatgatgatctaattattggtcttaaaggaaaggagagggaactgaagttggcaggtagatttttctccctaatgtcttggaaattgcgagaatactttgtaattaccgaatatttgataaagactcatttcgtccctatgtttaaaggcctgacaatggcggacgatctaactgcagtcattaaaaagatgttagattcctcatccggccaaggattgaagtcatatgaggcaatttgcatagccaatcacattgattacgaaaaatggaataaccaccaaaggaagttatcaaacggcccagtgttccgagttatgggccagttcttaggttatccatccttaatcgagagaactcatgaattttttgagaaaagtcttatatactacaatggaagaccagacttgatgcgtgttcacaacaacacactgatcaattcaacctcccaacgagtttgttggcaaggacaagagggtggactggaaggtctacggcaaaaaggatggagtatcctcaatctactggttattcaaagagaggctaaaatcagaaacactgctgtcaaagtcttggcacaaggtgataatcaagttatttgcacacagtataaaacgaagaaatcgagaaacgttgtagaattacagggtgctctcaatcaaatggtttctaataatgagaaaattatgactgcaatcaaaatagggacagggaagttaggacttttgataaatgacgatgagactatgcaatctgcagattacttgaattatggaaaaataccgattttccgtggagtgattagagggttagagaccaagagatggtcacgagtgacttgtgtcaccaatgaccaaatacccacttgtgctaatataatgagctcagtttccacaaatgctctcaccgtagctcattttgctgagaacccaatcaatgccatgatacagtacaattattttgggacatttgctagactcttgttgatgatgcatgatcctgctcttcgtcaatcattgtatgaagttcaagataagataccaggcttgcacagttctactttcaaatacgccatgttgtatttggacccttccattggaggagtgtcgggcatgtctttgtccaggtttttgattagagccttcccagatcccgtaacagaaagtctctcattctggagattcatccatgtacatgctcgaagtgagcatctgaaggagatgagtgcagtatttggaaaccccgagatagccaagtttcgaataactcacatagacaagctagtagaagatccaacctctctgaacatcgctatgggaatgagtccagcgaacttgttaaagactgaggttaaaaaatgcttaatcgaatcaagacaaaccatcaggaaccaggtgattaaggatgcaaccatatatttgtatcatgaagaggatcggctcagaagtttcttatggtcaataaatcctctgttccctagatttttaagtgaattcaaatcaggcacttttttgggagtcgcagacgggctcatcagtctatttcaaaattctcgtactattcggaactcctttaagaaaaagtatcatagggaattggatgatttgattgtgaggagtgaggtatcctctttgacacatttagggaaacttcatttgagaaggggatcatgtaaaatgtggacatgttcagctactcatgctgacacattaagatacaaatcctggggccgtacagttattgggacaactgtaccccatccattagaaatgttgggtccacaacatcgaaaagagactccttgtgcaccatgtaacacatcagggttcaattatgtttctgtgcattgtccagacgggatccatgacgtctttagttcacggggaccattgcctgcttatctagggtctaaaacatctgaatctacatctattttgcagccttgggaaagggaaagcaaagtcccactgattaaaagagctacacgtcttagagatgctatctcttggtttgttgaacccgactctaaactagcaatgactatactttctaacatccactctttaacaggcgaagaatggaccaaaaggcagcatgggttcaaaagaacagggtctgcccttcataggttttcgacatctcggatgagccatggtgggttcgcatctcagagcactgcagcattgaccaggttgatggcaactacagacaccatgagggatctgggagatcagaatttcgactttttattccaagcaacgttgctctatgctcaaattaccaccactgttgcaagagacggatggatcaccagttgtacagatcattatcatattgcctgtaagtcctgtttgagacccatagaagagatcaccctggactcaagtatggactacacgcccccagatgtatcccatgtgctgaagacatggaggaatggggaaggttcgtggggacaagagataaaacagatatatcctttagaagggaattggaagaatttagcacctgctgagcaatcctatcaagtcggcagatgtataggttttctatatggagacttggcgtatagaaaatctactcatgccgaggacagttctctatttcctctatctatacaaggtcgtattagaggtcgaggtttcttaaaagggttgctagacggattaatgagagcaagttgctgccaagtaatacaccggagaagtctggctcatttgaagaggccggccaacgcagtgtacggaggtttgatttacttgattgataaattgagtgtatcacctccattcctttctcttactagatcaggacctattagagacgaattagaaacgattccccacaagatcccaacctcctatccgacaagcaaccgtgatatgggggtgattgtcagaaattacttcaaataccaatgccgtctaattgaaaagggaaaatacagatcacattattcacaattatggttattctcagatgtcttatccatagacttcattggaccattctctatttccaccaccctcttgcaaatcctatacaagccatttttatctgggaaagataagaatgagttgagagagctggcaaatctttcttcattgctaagatcaggagaggggtgggaagacatacatgtgaaattcttcaccaaggacatattattgtgtccagaggaaatcagacatgcttgcaagttcgggattgctaaggataataataaagacatgagctatcccccttggggaagggaatccagagggacaattacaacaatccctgtttattatacgaccaccccttacccaaagatgctagagatgcctccaagaatccaaaatcccctgctgtccggaatcaggttgggccaattaccaactggcgctcattataaaattcggagtatattacatggaatgggaatccattacagggacttcttgagttgtggagacggctccggagggatgactgctgcattactacgagaaaatgtgcatagcagaggaatattcaatagtctgttagaattatcagggtcagtcatgcgaggcgcctctcctgagccccccagtgccctagaaactttaggaggagataaatcgagatgtgtaaatggtgaaacatgttgggaatatccatctgacttatgtgacccaaggacttgggactatttcctccgactcaaagcaggcttggggcttcaaattgatttaattgtaatggatatggaagttcgggattcttctactagcctgaaaattgagacgaatgttagaaattatgtgcaccggattttggatgagcaaggagttttaatctacaagacttatggaacatatatttgtgagagcgaaaagaatgcagtaacaatccttggtcccatgttcaagacggtcgacttagttcaaacagaatttagtagttctcaaacgtctgaagtatatatggtatgtaaaggtttgaagaaattaatcgatgaacccaatcccgattggtcttccatcaatgaatcctggaaaaacctgtacgcattccagtcatcagaacaggaatttgccagagcaaagaaggttagtacatactttaccttgacaggtattccctcccaattcattcctgatccttttgtaaacattgagactatgctacaaatattcggagtacccacgggtgtgtctcatgcggctgccttaaaatcatctgatagacctgcagatttattgaccattagccttttttatatggcgattatatcgtattataacatcaatcatatcagagtaggaccgatacctccgaaccccccatcagatggaattgcacaaaatgtggggatcgctataactggtataagcttttggctgagtttgatggagaaagacattccactatatcaacagtgtttagcagttatccagcaatcattcccgattaggtgggaggctgtttcagtaaaaggaggatacaagcagaagtggagtactagaggtgatgggctcccaaaagatacccgaatttcagactccttggccccaatcgggaactggatcagatctctggaattggtccgaaaccaagttcgtctaaatccattcaatgagatcttgttcaatcagctatgtcgtacagtggataatcatttgaaatggtcaaatttgcgaagaaacacaggaatgattgaatggatcaatagacgaatttcaaaagaagaccggtctatactgatgttgaagagtgacctacacgaggaaaactcttggagagattaaaaaatcatgaggagactccaaactttaagtatgaaaaaaactttgatccttaagaccctcttgtggtttttattttttatctggttttgtggtcttcgt

SEQ ID NO: 155 - protein, 422 aa, Artificial Sequence
  Synthetic: Amino acid sequence for VSV-N protein in rVSV-delta-G-SARS-CoV-2 clones MB1 and MB2, and Vectors A and B
MSVTVKRIIDNTVVVPKLPANEDPVEYPADYFRKSKEIPLYINTTKSLSDLRGYVYQGLKSGNVSIIHVNSYLYGALKDIRGKLDKDWSSFGINIGKAGDTIGIFDLVSLKALDGVLPDGVSDASRTSADDKWLPLYLLGLYRVGRTQMPEYRKKLMDGLTNQCKMINEQFEPLVPEGRDIFDVWGNDSNYTKIVAAVDMFFHMFKKHECASFRYGTIVSRFKDCAALATFGHLCKITGMSTEDVTTWILNREVADEMVQMMLPGQEIDKADSYMPYLIDFGLSSKSPYSSVKNPAFHFWGQLTALLLRSTRARNARQPDDIEYTSLTTAGLLYAYAVGSSADLAQQFCVGDNKYTPDDSTGGLTTNAPPQGRDVVEWLGWFEDQNRKPTPDMMQYAKRAVMSLQGLREKTIGKYAKSEFDK

SEQ ID NO: 156 - protein, 265 aa, Artificial Sequence
  Synthetic: Amino acid sequence for VSV-P protein in rVSV-delta-G-SARS-CoV-2 clones MB1 and MB2, and Vectors A and B
MDNLTKVREYLKSYSRLDQAVGEIDEIEAQRAEKSNYELFQEDGVEEHTKPSYFQAADDSDTESEPEIEDNQGLYAPDPEAEQVEGFIQGPLDDYADEEVDVVFTSDWKQPELESDEHGKTLRLTSPEGLSGEQKSQWLSTIKAVVQSAKYWNLAECTFEASGEGVIMKERQITPDVYKVTPVMNTHPSQSEAVSDVWSLSKTSMTFQPKKASLQPLTISLDELFSSRGEFISVGGDGRMSHKEAILLGLRYKKLYNQARVKYSL

SEQ ID NO: 157 - protein, 229 aa, Artificial Sequence
  Synthetic: Amino acid sequence for VSV-M protein in rVSV-delta-G-SARS-CoV-2 clone MB2, and Vectors A and B
MSSLKKILGLKGKGKKSKKLGIAPPPYEEDTSMEYAPSAPIDKSYFGVDEMDTYDPNQLRYEKFFFTVKMTVRSNRPFRTYSDVAAAVSHWDHMYIGMAGKRPFYKILAFLGSSNLKATPAVLADQGQPEYHAHCEGRAYLPHRMGKTPPMLNVPEHFRRPFNIGLYKGTIELTMTIYDDESLEAAPMIWDHFNSSKFSDFREKALMFGLIVEKKASGAWVLDSIGHFK

SEQ ID NO: 158 - protein, 1250 aa, Artificial Sequence
  Synthetic: Amino acid sequence for SARS-CoV-2 S protein in rVSV-delta-G-SARS-CoV-2 clone MB2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSC

SEQ ID NO: 159 - DNA, 13441 bp, Artificial Sequence
  Synthetic: Nucleotide sequence for rVSV-delta-G-SARS-CoV-2 with codon-optimized, wild-type S protein
acgaagacaaacaaaccattattatcattaaaaggctcaggagaaactttaacagtaatcaaaatgtctgttacagtcaagagaatcattgacaacacagtcgtagttccaaaacttcctgcaaatgaggatccagtggaatacccggcagattacttcagaaaatcaaaggagattcctctttacatcaatactacaaaaagtttgtcagatctaagaggatatgtctaccaaggcctcaaatccggaaatgtatcaatcatacatgtcaacagctacttgtatggagcattaaaggacatccggggtaagttggataaagattggtcaagtttcggaataaacatcgggaaagcaggggatacaatcggaatatttgaccttgtatccttgaaagccctggacggcgtacttccagatggagtatcggatgcttccagaaccagcgcagatgacaaatggttgcctttgtatctacttggcttatacagagtgggcagaacacaaatgcctgaatacagaaaaaagctcatggatgggctgacaaatcaatgcaaaatgatcaatgaacagtttgaacctcttgtgccagaaggtcgtgacatttttgatgtgtggggaaatgacagtaattacacaaaaattgtcgctgcagtggacatgttcttccacatgttcaaaaaacatgaatgtgcctcgttcagatacggaactattgtttccagattcaaagattgtgctgcattggcaacatttggacacctctgcaaaataaccggaatgtctacagaagatgtaacgacctggatcttgaaccgagaagttgcagatgaaatggtccaaatgatgcttccaggccaagaaattgacaaggccgattcatacatgccttatttgatcgactttggattgtcttctaagtctccatattcttccgtcaaaaaccctgccttccacttctgggggcaattgacagctcttctgctcagatccaccagagcaaggaatgcccgacagcctgatgacattgagtatacatctcttactacagcaggtttgttgtacgcttatgcagtaggatcctctgccgacttggcacaacagttttgtgttggagataacaaatacactccagatgatagtaccggaggattgacgactaatgcaccgccacaaggcagagatgtggtcgaatggctcggatggtttgaagatcaaaacagaaaaccgactcctgatatgatgcagtatgcgaaaagagcagtcatgtcactgcaaggcctaagagagaagacaattggcaagtatgctaagtcagaatttgacaaatgaccctataattctcagatcacctattatatattatgctacatatgaaaaaaactaacagatatcatggataatctcacaaaagttcgtgagtatctcaagtcctattctcgtctggatcaggcggtaggagagatagatgagatcgaagcacaacgagctgaaaagtccaattatgagttgttccaagaggatggagtggaagagcatactaagccctcttattttcaggcagcagatgattctgacacagaatctgaaccagaaattgaagacaatcaaggcttgtatgcaccagatccagaagctgagcaagttgaaggctttatacaggggcctttagatgactatgcagatgaggaagtggatgttgtatttacttcggactggaaacagcctgagcttgaatctgacgagcatggaaagaccttacggttgacatcgccagagggtttaagtggagagcagaaatcccagtggctttcgacgattaaagcagtcgtgcaaagtgccaaatactggaatctggcagagtgcacatttgaagcatcgggagaaggggtcattatgaaggagcgccagataactccggatgtatataaggtcactccagtgatgaacacacatccgtcccaatcagaagcagtatcagatgtttggtctctctcaaagacatccatgactttccaacccaagaaagcaagtcttcagcctctcaccatatccttggatgaattgttctcatctagaggagagttcatctctgtcggaggtgacggacgaatgtctcataaagaggccatcctgctcggcctgagatacaaaaagttgtacaatcaggcgagagtcaaatattctctgtagactatgaaaaaaagtaacagatatcacgatctaagtgttatcccaatccattcatcatgagttccttaaagaagattctcggtctgaaggggaaaggtaagaaatctaagaaattagggatcgcaccacccccttatgaagaggacactagcatggagtatgctccgagcgctccaattgacaaatcctattttggagttgacgagatggacacctatgatccgaatcaattaagatatgagaaattcttctttacagtgaaaatgacggttagatctaatcgtccgttcagaacatactcagatgtggcagccgctgtatcccattgggatcacatgtacatcggaatggcagggaaacgtcccttctacaaaatcttggcttttttgggttcttctaatctaaaggccactccagcggtattggcagatcaaggtcaaccagagtatcacgctcactgcgaaggcagggcttatttgccacataggatggggaagacccctcccatgctcaatgtaccagagcacttcagaagaccattcaatataggtctttacaagggaacgattgagctcacaatgaccatctacgatgatgagtcactggaagcagctcctatgatctgggatcatttcaattcttccaaattttctgatttcagagagaaggccttaatgtttggcctgattgtcgagaaaaaggcatctggagcgtgggtcctggactctatcggccacttcaaatgagctagtctaacttctagcttctgaacaatccccggtttactcagtctcccctaattccagcctctcgaacaactaatatcctgtcttttctatccctatgaaaaaaactaacagagatcgatctgtttacgcgctagtggatcctactcgagaggagccaccatgttcgtgttcctggtgctattacctctggtttcgtctcaatgcgtaaaccttacaactagaactcagcttcctccagcatacacaaattccttcactcgcggagtgtattatcctgataaggtctttcgatcatcagtgttgcattccacccaggatttgtttctcccgttcttttcaaatgtaacttggttccatgctatacatgtttccggaaccaatggaacaaagagatttgataacccagtgttaccatttaacgacggagtttatttcgcatcaactgagaaatccaatatcattagaggctggattttcggaacgaccctggattctaaaacgcaatccttgctgattgttaataatgcaacaaatgtggtcattaaagtctgtgaattccaattttgcaatgatccatttctcggcgtctattaccacaagaataacaaatcttggatggagtcagagttcagggtttatagttccgcaaataattgtacttttgaatacgtttcccaaccattcttaatggacttggagggaaaacagggaaattttaagaatctaagagaattcgtctttaagaatattgatggatatttcaagatctattcaaaacatacacctataaacctagttagagatctcccgcaagggttttcagccctagagccactagttgacctgccaattgggatcaacattactagattccagaccctactcgctctgcatcggtcatatttgacaccaggagattcatcgtcaggatggaccgctggagcagctgcttactatgttgggtatctgcaacctagaacatttctcctaaagtataatgaaaacgggactattacagacgcagtcgattgcgcactggatccactctcagagacaaagtgcactctaaaatcattcactgtcgagaaaggaatctatcaaacatcaaatttcagggtccagccaactgagagtattgtccggttccctaacataactaacttgtgccccttcggagaggttttcaatgctactcggttcgccagcgtctacgcatggaacagaaagaggatttcaaactgtgtcgcagattatagcgtcctctataattcagcatcattcagtacatttaaatgctatggtgtcagccccaccaaacttaatgacttatgttttaccaatgtatatgcagattcctttgtaatcagaggtgacgaagtgaggcaaatcgcacctggacagaccggaaagattgctgattataattataaactccctgatgattttaccggatgtgttattgcttggaacagcaataacctcgatagtaaggtcggaggaaactataactatttgtacagactgtttagaaagtcgaatttgaaaccttttgaaagagacatatccaccgagatttaccaggcgggcagcacaccgtgtaatggtgtagaaggattcaattgttactttcccctgcaatcatatgggtttcaaccaaccaatggagtcggatatcaaccatatcgtgtcgtcgtcctttccttcgagctgcttcatgcaccagctacagtctgcggacctaagaagagcactaatcttgtcaagaacaaatgtgtgaactttaattttaatggattaacaggaaccggagttttgaccgagagtaataagaagttcttgccgttccagcaatttggacgagacattgctgacaccacagatgcggttcgtgacccgcaaactttagagatcctagacatcaccccatgttcattcggtggagtttccgttattactcctggaacgaatacaagcaatcaagttgccgttctctatcaagatgttaattgtacagaagtgcctgtggccattcatgcagatcaactaacaccaacttggagagtttacagcactgggtccaatgtcttccaaacgcgcgccggctgcctcattggtgcagaacatgtgaataactcatacgaatgtgacattccaatcggtgccggcatatgcgcctcttaccagactcagactaattcgccaagaagagccaggtctgtcgcaagtcagtcaattattgcatacacaatgtcgttaggagcagagaatagtgtagcatactcaaacaattctatagcaatacctaccaacttcactatatcagtaactacagaaatattgccagtatccatgactaaaacaagtgtggattgcaccatgtacatctgtggagattccacagaatgcagcaatcttctcttgcaatacggatcattctgcacacaactgaatagggcactgactggaattgcagtcgagcaggataagaacacacaggaggtgtttgcccaagtcaaacaaatatacaaaacaccacccatcaaggattttggaggatttaatttctcacaaatactccccgacccatccaagccctccaaaaggagtttcattgaggacctcttgtttaataaggttaccttggcagatgccgggtttattaagcagtacggcgactgtcttggagacatagcagccagagatctaatttgtgcccagaaattcaatggactgacagtcctgcctcccttattaactgatgagatgatagctcagtatacatcagcattgttggctggtacaattacatctggatggacatttggtgccggagcggcattacaaatcccttttgcaatgcaaatggcctatagatttaatggaatcggagtaactcaaaatgttttatatgagaatcagaaattaattgcaaatcaattcaattcagctataggaaagattcaggattcactcagtagtacagcaagcgctctaggcaaattacaagacgtcgtcaatcagaatgcacaggcattaaatacactggtgaagcaattgagttccaatttcggagcaatttcatctgttctaaatgatatattgtcaagactggataaagtagaagccgaggtccaaatcgataggctgatcacaggaagacttcaatcactacagacatacgtcacccaacaactcatcagagcagcagaaattagagcctctgctaatctagccgcaacaaagatgtcagagtgcgtattgggacaatctaagagggtcgacttttgtggaaaggggtatcacttgatgtcctttcctcaatctgcaccacacggagttgtcttcttacatgtaacatatgtgcccgctcaagaaaagaatttcactacagcacctgcaatatgtcatgacggaaaagcacattttcctcgggagggagttttcgtttctaatggaacccattggttcgtgacccaaaggaacttttacgagcctcaaataattacaactgataatacattcgtttctggaaattgcgacgtagttataggtattgtaaataatactgtttatgaccctttacaacctgaactcgattccttcaaggaagaactcgacaaatattttaagaatcacacctcaccggacgttgacttaggagacatttccgggattaacgctagtgtagtcaatatccaaaaggagatagatagactgaatgaggtagcaaagaatcttaatgaatctttgatcgaccttcaggagctggggaagtacgaacaatacataaaatggccatggtacatttggctcgggtttattgctggactaattgcaatagtcatggtcactatcatgctgtgttgtatgacatcgtgctgctcatgcctcaagggatgttgtagctgtggatcttgttgcaagttcgatgaggatgattcagaaccagttttaaaaggagtaaagttgcattacacataaaggctagctgtttacgcgttatccatgctcaaagaggcctcaattatatttgagtttttaatttttatgaaaaaaaactaacagcaatcatggaagtccacgattttgagaccgacgagttcaatgatttcaatgaagatgactatgccacaagagaattcctgaatcccgatgagcgcatgacgtacttgaatcatgctgattacaacctgaattctcctctaattagtgatgatattgacaatttaatcaggaaattcaattctcttccaattccctcgatgtgggatagtaagaactgggatggagttcttgagatgttaacgtcatgtcaagccaatcccatcccaacatctcagatgcataaatggatgggaagttggttaatgtctgataatcatgatgccagtcaagggtatagttttttacatgaagtggacaaagaggcagaaataacatttgacgtggtggagaccttcatccgcggctggggcaacaaaccaattgaatacatcaaaaaggaaagatggactgactcattcaaaattctcgcttatttgtgtcaaaagtttttggacttacacaagttgacattaatcttaaatgctgtctctgaggtggaattgctcaacttggcgaggactttcaaaggcaaagtcagaagaagttctcatggaacgaacatatgcaggattagggttcccagcttgggtcctacttttatttcagaaggatgggcttacttcaagaaacttgatattctaatggaccgaaactttctgttaatggtcaaagatgtgattatagggaggatgcaaacggtgctatccatggtatgtagaatagacaacctgttctcagagcaagacatcttctcccttctaaatatctacagaattggagataaaattgtggagaggcagggaaatttttcttatgacttgattaaaatggtggaaccgatatgcaacttgaagctgatgaaattagcaagagaatcaaggcctttagtcccacaattccctcattttgaaaatcatatcaagacttctgttgatgaaggggcaaaaattgaccgaggtataagattcctccatgatcagataatgagtgtgaaaacagtggatctcacactggtgatttatggatcgttcagacattggggtcatccttttatagattattacactggactagaaaaattacattcccaagtaaccatgaagaaagatattgatgtgtcatatgcaaaagcacttgcaagtgatttagctcggattgttctatttcaacagttcaatgatcataaaaagtggttcgtgaatggagacttgctccctcatgatcatccctttaaaagtcatgttaaagaaaatacatggcccacagctgctcaagttcaagattttggagataaatggcatgaacttccgctgattaaatgttttgaaatacccgacttactagacccatcgataatatactctgacaaaagtcattcaatgaataggtcagaggtgttgaaacatgtccgaatgaatccgaacactcctatccctagtaaaaaggtgttgcagactatgttggacacaaaggctaccaattggaaagaatttcttaaagagattgatgagaagggcttagatgatgatgatctaattattggtcttaaaggaaaggagagggaactgaagttggcaggtagatttttctccctaatgtcttggaaattgcgagaatactttgtaattaccgaatatttgataaagactcatttcgtccctatgtttaaaggcctgacaatggcggacgatctaactgcagtcattaaaaagatgttagattcctcatccggccaaggattgaagtcatatgaggcaatttgcatagccaatcacattgattacgaaaaatggaataaccaccaaaggaagttatcaaacggcccagtgttccgagttatgggccagttcttaggttatccatccttaatcgagagaactcatgaattttttgagaaaagtcttatatactacaatggaagaccagacttgatgcgtgttcacaacaacacactgatcaattcaacctcccaacgagtttgttggcaaggacaagagggtggactggaaggtctacggcaaaaaggatggagtatcctcaatctactggttattcaaagagaggctaaaatcagaaacactgctgtcaaagtcttggcacaaggtgataatcaagttatttgcacacagtataaaacgaagaaatcgagaaacgttgtagaattacagggtgctctcaatcaaatggtttctaataatgagaaaattatgactgcaatcaaaatagggacagggaagttaggacttttgataaatgacgatgagactatgcaatctgcagattacttgaattatggaaaaataccgattttccgtggagtgattagagggttagagaccaagagatggtcacgagtgacttgtgtcaccaatgaccaaatacccacttgtgctaatataatgagctcagtttccacaaatgctctcaccgtagctcattttgctgagaacccaatcaatgccatgatacagtacaattattttgggacatttgctagactcttgttgatgatgcatgatcctgctcttcgtcaatcattgtatgaagttcaagataagataccaggcttgcacagttctactttcaaatacgccatgttgtatttggacccttccattggaggagtgtcgggcatgtctttgtccaggtttttgattagagccttcccagatcccgtaacagaaagtctctcattctggagattcatccatgtacatgctcgaagtgagcatctgaaggagatgagtgcagtatttggaaaccccgagatagccaagtttcgaataactcacatagacaagctagtagaagatccaacctctctgaacatcgctatgggaatgagtccagcgaacttgttaaagactgaggttaaaaaatgcttaatcgaatcaagacaaaccatcaggaaccaggtgattaaggatgcaaccatatatttgtatcatgaagaggatcggctcagaagtttcttatggtcaataaatcctctgttccctagatttttaagtgaattcaaatcaggcacttttttgggagtcgcagacgggctcatcagtctatttcaaaattctcgtactattcggaactcctttaagaaaaagtatcatagggaattggatgatttgattgtgaggagtgaggtatcctctttgacacatttagggaaacttcatttgagaaggggatcatgtaaaatgtggacatgttcagctactcatgctgacacattaagatacaaatcctggggccgtacagttattgggacaactgtaccccatccattagaaatgttgggtccacaacatcgaaaagagactccttgtgcaccatgtaacacatcagggttcaattatgtttctgtgcattgtccagacgggatccatgacgtctttagttcacggggaccattgcctgcttatctagggtctaaaacatctgaatctacatctattttgcagccttgggaaagggaaagcaaagtcccactgattaaaagagctacacgtcttagagatgctatctcttggtttgttgaacccgactctaaactagcaatgactatactttctaacatccactctttaacaggcgaagaatggaccaaaaggcagcatgggttcaaaagaacagggtctgcccttcataggttttcgacatctcggatgagccatggtgggttcgcatctcagagcactgcagcattgaccaggttgatggcaactacagacaccatgagggatctgggagatcagaatttcgactttttattccaagcaacgttgctctatgctcaaattaccaccactgttgcaagagacggatggatcaccagttgtacagatcattatcatattgcctgtaagtcctgtttgagacccatagaagagatcaccctggactcaagtatggactacacgcccccagatgtatcccatgtgctgaagacatggaggaatggggaaggttcgtggggacaagagataaaacagatctatcctttagaagggaattggaagaatttagcacctgctgagcaatcctatcaagtcggcagatgtataggttttctatatggagacttggcgtatagaaaatctactcatgccgaggacagttctctatttcctctatctatacaaggtcgtattagaggtcgaggtttcttaaaagggttgctagacggattaatgagagcaagttgctgccaagtaatacaccggagaagtctggctcatttgaagaggccggccaacgcagtgtacggaggtttgatttacttgattgataaattgagtgtatcacctccattcctttctcttactagatcaggacctattagagacgaattagaaacgattccccacaagatcccaacctcctatccgacaagcaaccgtgatatgggggtgattgtcagaaattacttcaaataccaatgccgtctaattgaaaagggaaaatacagatcacattattcacaattatggttattctcagatgtcttatccatagacttcattggaccattctctatttccaccaccctcttgcaaatcctatacaagccatttttatctgggaaagataagaatgagttgagagagctggcaaatctttcttcattgctaagatcaggagaggggtgggaagacatacatgtgaaattcttcaccaaggacatattattgtgtccagaggaaatcagacatgcttgcaagttcgggattgctaaggataataataaagacatgagctatcccccttggggaagggaatccagagggacaattacaacaatccctgtttattatacgaccaccccttacccaaagatgctagagatgcctccaagaatccaaaatcccctgctgtccggaatcaggttgggccaattaccaactggcgctcattataaaattcggagtatattacatggaatgggaatccattacagggacttcttgagttgtggagacggctccggagggatgactgctgcattactacgagaaaatgtgcatagcagaggaatattcaatagtctgttagaattatcagggtcagtcatgcgaggcgcctctcctgagccccccagtgccctagaaactttaggaggagataaatcgagatgtgtaaatggtgaaacatgttgggaatatccatctgacttatgtgacccaaggacttgggactatttcctccgactcaaagcaggcttggggcttcaaattgatttaattgtaatggatatggaagttcgggattcttctactagcctgaaaattgagacgaatgttagaaattatgtgcaccggattttggatgagcaaggagttttaatctacaagacttatggaacatatatttgtgagagcgaaaagaatgcagtaacaatccttggtcccatgttcaagacggtcgacttagttcaaacagaatttagtagttctcaaacgtctgaagtatatatggtatgtaaaggtttgaagaaattaatcgatgaacccaatcccgattggtcttccatcaatgaatcctggaaaaacctgtacgcattccagtcatcagaacaggaatttgccagagcaaagaaggttagtacatactttaccttgacaggtattccctcccaattcattcctgatccttttgtaaacattgagactatgctacaaatattcggagtacccacgggtgtgtctcatgcggctgccttaaaatcatctgatagacctgcagatttattgaccattagccttttttatatggcgattatatcgtattataacatcaatcatatcagagtaggaccgatacctccgaaccccccatcagatggaattgcacaaaatgtggggatcgctataactggtataagcttttggctgagtttgatggagaaagacattccactatatcaacagtgtttagcagttatccagcaatcattcccgattaggtgggaggctgtttcagtaaaaggaggatacaagcagaagtggagtactagaggtgatgggctcccaaaagatacccgaatttcagactccttggccccaatcgggaactggatcagatctctggaattggtccgaaaccaagttcgtctaaatccattcaatgagatcttgttcaatcagctatgtcgtacagtggataatcatttgaaatggtcaaatttgcgaagaaacacaggaatgattgaatggatcaatagacgaatttcaaaagaagaccggtctatactgatgttgaagagtgacctacacgaggaaaactcttggagagattaaaaaatcatgaggagactccaaactttaagtatgaaaaaaactttgatccttaagaccctcttgtggtttttattttttatctggttttgtggtcttcgt

SEQ ID NO: 160 - DNA, 9606 bp, Artificial Sequence
  Synthetic: Nucleotide sequence for Vector A, which is a VSV vector without the VSV-G gene.
acgaagacaaacaaaccattattatcattaaaaggctcaggagaaactttaacagtaatcaaaatgtctgttacagtcaagagaatcattgacaacacagtcgtagttccaaaacttcctgcaaatgaggatccagtggaatacccggcagattacttcagaaaatcaaaggagattcctctttacatcaatactacaaaaagtttgtcagatctaagaggatatgtctaccaaggcctcaaatccggaaatgtatcaatcatacatgtcaacagctacttgtatggagcattaaaggacatccggggtaagttggataaagattggtcaagtttcggaataaacatcgggaaagcaggggatacaatcggaatatttgaccttgtatccttgaaagccctggacggcgtacttccagatggagtatcggatgcttccagaaccagcgcagatgacaaatggttgcctttgtatctacttggcttatacagagtgggcagaacacaaatgcctgaatacagaaaaaagctcatggatgggctgacaaatcaatgcaaaatgatcaatgaacagtttgaacctcttgtgccagaaggtcgtgacatttttgatgtgtggggaaatgacagtaattacacaaaaattgtcgctgcagtggacatgttcttccacatgttcaaaaaacatgaatgtgcctcgttcagatacggaactattgtttccagattcaaagattgtgctgcattggcaacatttggacacctctgcaaaataaccggaatgtctacagaagatgtaacgacctggatcttgaaccgagaagttgcagatgaaatggtccaaatgatgcttccaggccaagaaattgacaaggccgattcatacatgccttatttgatcgactttggattgtcttctaagtctccatattcttccgtcaaaaaccctgccttccacttctgggggcaattgacagctcttctgctcagatccaccagagcaaggaatgcccgacagcctgatgacattgagtatacatctcttactacagcaggtttgttgtacgcttatgcagtaggatcctctgccgacttggcacaacagttttgtgttggagataacaaatacactccagatgatagtaccggaggattgacgactaatgcaccgccacaaggcagagatgtggtcgaatggctcggatggtttgaagatcaaaacagaaaaccgactcctgatatgatgcagtatgcgaaaagagcagtcatgtcactgcaaggcctaagagagaagacaattggcaagtatgctaagtcagaatttgacaaatgaccctataattctcagatcacctattatatattatgctacatatgaaaaaaactaacagatatcatggataatctcacaaaagttcgtgagtatctcaagtcctattctcgtctggatcaggcggtaggagagatagatgagatcgaagcacaacgagctgaaaagtccaattatgagttgttccaagaggatggagtggaagagcatactaagccctcttattttcaggcagcagatgattctgacacagaatctgaaccagaaattgaagacaatcaaggcttgtatgcaccagatccagaagctgagcaagttgaaggctttatacaggggcctttagatgactatgcagatgaggaagtggatgttgtatttacttcggactggaaacagcctgagcttgaatctgacgagcatggaaagaccttacggttgacatcgccagagggtttaagtggagagcagaaatcccagtggctttcgacgattaaagcagtcgtgcaaagtgccaaatactggaatctggcagagtgcacatttgaagcatcgggagaaggggtcattatgaaggagcgccagataactccggatgtatataaggtcactccagtgatgaacacacatccgtcccaatcagaagcagtatcagatgtttggtctctctcaaagacatccatgactttccaacccaagaaagcaagtcttcagcctctcaccatatccttggatgaattgttctcatctagaggagagttcatctctgtcggaggtgacggacgaatgtctcataaagaggccatcctgctcggcctgagatacaaaaagttgtacaatcaggcgagagtcaaatattctctgtagactatgaaaaaaagtaacagatatcacgatctaagtgttatcccaatccattcatcatgagttccttaaagaagattctcggtctgaaggggaaaggtaagaaatctaagaaattagggatcgcaccacccccttatgaagaggacactagcatggagtatgctccgagcgctccaattgacaaatcctattttggagttgacgagatggacacctatgatccgaatcaattaagatatgagaaattcttctttacagtgaaaatgacggttagatctaatcgtccgttcagaacatactcagatgtggcagccgctgtatcccattgggatcacatgtacatcggaatggcagggaaacgtcccttctacaaaatcttggcttttttgggttcttctaatctaaaggccactccagcggtattggcagatcaaggtcaaccagagtatcacgctcactgcgaaggcagggcttatttgccacataggatggggaagacccctcccatgctcaatgtaccagagcacttcagaagaccattcaatataggtctttacaagggaacgattgagctcacaatgaccatctacgatgatgagtcactggaagcagctcctatgatctgggatcatttcaattcttccaaattttctgatttcagagagaaggccttaatgtttggcctgattgtcgagaaaaaggcatctggagcgtgggtcctggactctatcggccacttcaaatgagctagtctaacttctagcttctgaacaatccccggtttactcagtctcccctaattccagcctctcgaacaactaatatcctgtcttttctatccctatgaaaaaaactaacagagatcgatctgtttacgcgctagtggatcctactcgaggctagctgtttacgcgttatccatgctcaaagaggcctcaattatatttgagtttttaatttttatgaaaaaaactaacagcaatcatggaagtccacgattttgagaccgacgagttcaatgatttcaatgaagatgactatgccacaagagaattcctgaatcccgatgagcgcatgacgtacttgaatcatgctgattacaacctgaattctcctctaattagtgatgatattgacaatttaatcaggaaattcaattctcttccaattccctcgatgtgggatagtaagaactgggatggagttcttgagatgttaacgtcatgtcaagccaatcccatcccaacatctcagatgcataaatggatgggaagttggttaatgtctgataatcatgatgccagtcaagggtatagttttttacatgaagtggacaaagaggcagaaataacatttgacgtggtggagaccttcatccgcggctggggcaacaaaccaattgaatacatcaaaaaggaaagatggactgactcattcaaaattctcgcttatttgtgtcaaaagtttttggacttacacaagttgacattaatcttaaatgctgtctctgaggtggaattgctcaacttggcgaggactttcaaaggcaaagtcagaagaagttctcatggaacgaacatatgcaggattagggttcccagcttgggtcctacttttatttcagaaggatgggcttacttcaagaaacttgatattctaatggaccgaaactttctgttaatggtcaaagatgtgattatagggaggatgcaaacggtgctatccatggtatgtagaatagacaacctgttctcagagcaagacatcttctcccttctaaatatctacagaattggagataaaattgtggagaggcagggaaatttttcttatgacttgattaaaatggtggaaccgatatgcaacttgaagctgatgaaattagcaagagaatcaaggcctttagtcccacaattccctcattttgaaaatcatatcaagacttctgttgatgaaggggcaaaaattgaccgaggtataagattcctccatgatcagataatgagtgtgaaaacagtggatctcacactggtgatttatggatcgttcagacattggggtcatccttttatagattattacactggactagaaaaattacattcccaagtaaccatgaagaaagatattgatgtgtcatatgcaaaagcacttgcaagtgatttagctcggattgttctatttcaacagttcaatgatcataaaaagtggttcgtgaatggagacttgctccctcatgatcatccctttaaaagtcatgttaaagaaaatacatggcccacagctgctcaagttcaagattttggagataaatggcatgaacttccgctgattaaatgttttgaaatacccgacttactagacccatcgataatatactctgacaaaagtcattcaatgaataggtcagaggtgttgaaacatgtccgaatgaatccgaacactcctatccctagtaaaaaggtgttgcagactatgttggacacaaaggctaccaattggaaagaatttcttaaagagattgatgagaagggcttagatgatgatgatctaattattggtcttaaaggaaaggagagggaactgaagttggcaggtagatttttctccctaatgtcttggaaattgcgagaatactttgtaattaccgaatatttgataaagactcatttcgtccctatgtttaaaggcctgacaatggcggacgatctaactgcagtcattaaaaagatgttagattcctcatccggccaaggattgaagtcatatgaggcaatttgcatagccaatcacattgattacgaaaaatggaataaccaccaaaggaagttatcaaacggcccagtgttccgagttatgggccagttcttaggttatccatccttaatcgagagaactcatgaattttttgagaaaagtcttatatactacaatggaagaccagacttgatgcgtgttcacaacaacacactgatcaattcaacctcccaacgagtttgttggcaaggacaagagggtggactggaaggtctacggcaaaaaggatggagtatcctcaatctactggttattcaaagagaggctaaaatcagaaacactgctgtcaaagtcttggcacaaggtgataatcaagttatttgcacacagtataaaacgaagaaatcgagaaacgttgtagaattacagggtgctctcaatcaaatggtttctaataatgagaaaattatgactgcaatcaaaatagggacagggaagttaggacttttgataaatgacgatgagactatgcaatctgcagattacttgaattatggaaaaataccgattttccgtggagtgattagagggttagagaccaagagatggtcacgagtgacttgtgtcaccaatgaccaaatacccacttgtgctaatataatgagctcagtttccacaaatgctctcaccgtagctcattttgctgagaacccaatcaatgccatgatacagtacaattattttgggacatttgctagactcttgttgatgatgcatgatcctgctcttcgtcaatcattgtatgaagttcaagataagataccaggcttgcacagttctactttcaaatacgccatgttgtatttggacccttccattggaggagtgtcgggcatgtctttgtccaggtttttgattagagccttcccagatcccgtaacagaaagtctctcattctggagattcatccatgtacatgctcgaagtgagcatctgaaggagatgagtgcagtatttggaaaccccgagatagccaagtttcgaataactcacatagacaagctagtagaagatccaacctctctgaacatcgctatgggaatgagtccagcgaacttgttaaagactgaggttaaaaaatgcttaatcgaatcaagacaaaccatcaggaaccaggtgattaaggatgcaaccatatatttgtatcatgaagaggatcggctcagaagtttcttatggtcaataaatcctctgttccctagatttttaagtgaattcaaatcaggcacttttttgggagtcgcagacgggctcatcagtctatttcaaaattctcgtactattcggaactcctttaagaaaaagtatcatagggaattggatgatttgattgtgaggagtgaggtatcctctttgacacatttagggaaacttcatttgagaaggggatcatgtaaaatgtggacatgttcagctactcatgctgacacattaagatacaaatcctggggccgtacagttattgggacaactgtaccccatccattagaaatgttgggtccacaacatcgaaaagagactccttgtgcaccatgtaacacatcagggttcaattatgtttctgtgcattgtccagacgggatccatgacgtctttagttcacggggaccattgcctgcttatctagggtctaaaacatctgaatctacatctattttgcagccttgggaaagggaaagcaaagtcccactgattaaaagagctacacgtcttagagatgctatctcttggtttgttgaacccgactctaaactagcaatgactatactttctaacatccactctttaacaggcgaagaatggaccaaaaggcagcatgggttcaaaagaacagggtctgcccttcataggttttcgacatctcggatgagccatggtgggttcgcatctcagagcactgcagcattgaccaggttgatggcaactacagacaccatgagggatctgggagatcagaatttcgactttttattccaagcaacgttgctctatgctcaaattaccaccactgttgcaagagacggatggatcaccagttgtacagatcattatcatattgcctgtaagtcctgtttgagacccatagaagagatcaccctggactcaagtatggactacacgcccccagatgtatcccatgtgctgaagacatggaggaatggggaaggttcgtggggacaagagataaaacagatctatcctttagaagggaattggaagaatttagcacctgctgagcaatcctatcaagtcggcagatgtataggttttctatatggagacttggcgtatagaaaatctactcatgccgaggacagttctctatttcctctatctatacaaggtcgtattagaggtcgaggtttcttaaaagggttgctagacggattaatgagagcaagttgctgccaagtaatacaccggagaagtctggctcatttgaagaggccggccaacgcagtgtacggaggtttgatttacttgattgataaattgagtgtatcacctccattcctttctcttactagatcaggacctattagagacgaattagaaacgattccccacaagatcccaacctcctatccgacaagcaaccgtgatatgggggtgattgtcagaaattacttcaaataccaatgccgtctaattgaaaagggaaaatacagatcacattattcacaattatggttattctcagatgtcttatccatagacttcattggaccattctctatttccaccaccctcttgcaaatcctatacaagccatttttatctgggaaagataagaatgagttgagagagctggcaaatctttcttcattgctaagatcaggagaggggtgggaagacatacatgtgaaattcttcaccaaggacatattattgtgtccagaggaaatcagacatgcttgcaagttcgggattgctaaggataataataaagacatgagctatcccccttggggaagggaatccagagggacaattacaacaatccctgtttattatacgaccaccccttacccaaagatgctagagatgcctccaagaatccaaaatcccctgctgtccggaatcaggttgggccaattaccaactggcgctcattataaaattcggagtatattacatggaatgggaatccattacagggacttcttgagttgtggagacggctccggagggatgactgctgcattactacgagaaaatgtgcatagcagaggaatattcaatagtctgttagaattatcagggtcagtcatgcgaggcgcctctcctgagccccccagtgccctagaaactttaggaggagataaatcgagatgtgtaaatggtgaaacatgttgggaatatccatctgacttatgtgacccaaggacttgggactatttcctccgactcaaagcaggcttggggcttcaaattgatttaattgtaatggatatggaagttcgggattcttctactagcctgaaaattgagacgaatgttagaaattatgtgcaccggattttggatgagcaaggagttttaatctacaagacttatggaacatatatttgtgagagcgaaaagaatgcagtaacaatccttggtcccatgttcaagacggtcgacttagttcaaacagaatttagtagttctcaaacgtctgaagtatatatggtatgtaaaggtttgaagaaattaatcgatgaacccaatcccgattggtcttccatcaatgaatcctggaaaaacctgtacgcattccagtcatcagaacaggaatttgccagagcaaagaaggttagtacatactttaccttgacaggtattccctcccaattcattcctgatccttttgtaaacattgagactatgctacaaatattcggagtacccacgggtgtgtctcatgcggctgccttaaaatcatctgatagacctgcagatttattgaccattagccttttttatatggcgattatatcgtattataacatcaatcatatcagagtaggaccgatacctccgaaccccccatcagatggaattgcacaaaatgtggggatcgctataactggtataagcttttggctgagtttgatggagaaagacattccactatatcaacagtgtttagcagttatccagcaatcattcccgattaggtgggaggctgtttcagtaaaaggaggatacaagcagaagtggagtactagaggtgatgggctcccaaaagatacccgaatttcagactccttggccccaatcgggaactggatcagatctctggaattggtccgaaaccaagttcgtctaaatccattcaatgagatcttgttcaatcagctatgtcgtacagtggataatcatttgaaatggtcaaatttgcgaagaaacacaggaatgattgaatggatcaatagacgaatttcaaaagaagaccggtctatactgatgttgaagagtgacctacacgaggaaaactcttggagagattaaaaaatcatgaggagactccaaactttaagtatgaaaaaaactttgatccttaagaccctcttgtggtttttattttttatctggttttgtggtcttcgt

SEQ ID NO: 161 - DNA, 9490 bp, Artificial Sequence
  Synthetic: Nucleotide sequence for Vector B, which is a VSV vector without the VSV-G gene.
acgaagacaaacaaaccattattatcattaaaaggctcaggagaaactttaacagtaatcaaaatgtctgttacagtcaagagaatcattgacaacacagtcatagttccaaaacttcctgcaaatgaggatccagtggaatacccggcagattacttcagaaaatcaaaggagattcctctttacatcaatactacaaaaagtttgtcagatctaagaggatatgtctaccaaggcctcaaatccggaaatgtatcaatcatacatgtcaacagctacttgtatggagcattgaaggacatccggggtaagttggataaagattggtcaagtttcggaataaacatcgggaaggcaggggatacaatcggaatatttgaccttgtatccttgaaagccctggacggtgtacttccagatggagtatcggatgcttccagaaccagcgcagatgacaaatggttgcctttgtatctacttggcttatacagagtgggcagaacacaaatgcctgaatacagaaaaaggctcatggatgggctgacaaatcaatgcaaaatgatcaatgaacagtttgaacctcttgtgccagaaggtcgtgacatttttgatgtgtggggaaatgacagtaattacacaaaaattgtcgctgcagtggacatgttcttccacatgttcaaaaaacatgaatgtgcctcgttcagatacggaactattgtttccagattcaaagattgtgctgcattggcaacatttggacacctctgcaaaataaccggaatgtctacagaagatgtgacgacctggatcttgaaccgagaagttgcagatgagatggtccaaatgatgcttccaggccaagaaattgacaaggctgattcatacatgccttatttgatcgactttggattgtcttctaagtctccatattcttccgtcaaaaaccctgccttccacttctgggggcaattgacagctcttctgctcagatccaccagagcaaggaatgcccgacagcctgatgacattgagtatacatctcttactacagcaggtttgttgtacgcttatgcagtaggatcctctgctgacttggcacaacagttttgtgttggagatagcaaatacactccagatgatagtaccggaggattgacgactaatgcaccgccacaaggcagagatgtggtcgaatggctcggatggtttgaagatcaaaacagaaaaccgactcctgatatgatgcagtatgcgaaacgagcagtcatgtcactgcaaggcctaagagagaagacaattggcaagtatgctaagtcagagtttgacaaatgaccctataattctcagatcacctattatatattatgctagctatgaaaaaaactaacagatatcatggataatctcacaaaagttcgtgagtatctcaagtcctattctcgtctagatcaggcggtaggagagatagatgagatcgaagcacaacgagctgaaaagtccaattatgagttgttccaagaggacggagtggaagagcatactaggccctcttattttcaggcagcagatgattctgacacagaatctgaaccagaaattgaagacaatcaaggcttgtatgtaccagatccggaagctgagcaagttgaaggctttatacaggggcctttagatgactatgcagatgaggacgtggatgttgtattcacttcggactggaaacagcctgagcttgaatccgacgagcatggaaagaccttacggttgacattgccagagggtttaagtggagagcagaaatcccagtggcttttgacgattaaagcagtcgttcaaagtgccaaacactggaatctggcagagtgcacatttgaagcatcgggagaaggggtcatcataaaaaagcgccagataactccggatgtatataaggtcactccagtgatgaacacacatccgtcccaatcagaagccgtatcagatgtttggtctctctcaaagacatccatgactttccaacccaagaaagcaagtcttcagcctctcaccatatccttggatgaattgttctcatctagaggagaattcatctctgtcggaggtaacggacgaatgtctcataaagaggccatcctgctcggtctgaggtacaaaaagttgtacaatcaggcgagagtcaaatattctctgtagactagtatgaaaaaaagtaacagatatcacaatctaagtgttatcccaatccattcatcatgagttccttaaagaagattctcggtctgaaggggaaaggtaagaaatctaagaaattagggatcgcaccacccccttatgaagaggacactaacatggagtatgctccgagcgctccaattgacaaatcctattttggagttgacgagatggacactcatgatccgaatcaattaagatatgagaaattcttctttacagtgaaaatgacggttagatctaatcgtccgttcagaacatactcagatgtggcagccgctgtatcccattgggatcacatgtacatcggaatggcagggaaacgtcccttctacaagatcttggcttttttgggttcttctaatctaaaggccactccagcggtattggcagatcaaggtcaaccagagtatcatgctcactgtgaaggcagggcttatttgccacacagaatggggaagacccctcccatgctcaatgtaccagagcacttcagaagaccattcaatataggtctttacaagggaacgattgagctcacaatgaccatctacgatgatgagtcactggaagcagctcctatgatctgggatcatttcaattcttccaaattttctgatttcagagagaaggccttaatgtttggcctgattgtcgagaaaaaggcatctggagcttgggtcctggattctgtcagccacttcaaatgagctagtctagcttccagcttctgaacaatccccggtttactcagtctctcctaattccagcctttcgaattaattaaattttaatttttaatttttatgaaaaaaaactaacagcaatcatggaagtccacgattttgagaccgacgagttcaatgatttcaatgaagatgactatgccacaagagaattcctgaatcccgatgagcgcatgacgtacttgaatcatgctgattacaatttgaattctcctctaattagtgatgatattgacaatttgatcaggaaattcaattctcttccgattccctcgatgtgggatagtaagaactgggatggagttcttgagatgttaacatcatgtcaagccaatcccatctcaacatctcagatgcataaatggatgggaagttggttaatgtctgataatcatgatgccagacaagggtatagttttttacatgaagtggacaaagaggcagaaataacatttgacgtggtggagaccttcatccgcggctggggcaacaaaccaattgaatacatcaaaaaggaaagatggactgactcattcaaaattctcgcttatttgtgtcaaaagtttttggacttacacaagttgacattaatcttaaatgctgtctctgaggtggaattgctcaacttggcgaggactttcaaaggcaaagtcagaagaagttctcatggaacgaacatatgcaggcttagggttcccagcttgggtcctacttttatttcagaaggatgggcttacttcaagaaacttgatattctaatggaccgaaactttctgttaatggtcaaagatgtgattatagggaggatgcaaacggtgctatccatggtatgtagaatagacaacctgttctcagagcaagacatcttctcccttctaaatatctacagaattggagataaaattgtggagaggcagggaaatttttcttatgacttgattaaaatggtggaaccgatatgcaacttgaagctgatgaaattagcaagagaatcaaggcctttagtcccacaattccctcattttgaaaatcatatcaagacttctgttgatgaaggggcaaaaattgaccgaggtataagattcctccatgatcagataatgagtgtgaaaacagtggatctcacactggtgatttatggatcgttcagacattggggtcatccttttatagattattacgctggactagaaaaattacattcccaagtaaccatgaagaaagatattgatgtgtcatatgcaaaagcacttgcaagtgatttagctcggattgttctatttcaacagttcaatgatcataaaaagtggttcgtgaatggagacttgctccctcatgatcatccctttaaaagtcatgttaaagaaaatacatggcctacagctgctcaagttcaagattttggagataaatggcatgaacttccgctgattaaatgttttgaaatacccgacttactagacccatcgataatatactctgacaaaagtcattcaatgaataggtcagaggtgttgaaacatgtccgaatgaatccgaacactcctatccctagtaaaaaggtgttgcagactatgttggacacaaaggctaccaattggaaagaatttcttaaagagattgatgagaagggcttagatgatgatgatctaattattggtcttaaaggaaaggagagggaactgaagttggcaggtagatttttctccctaatgtcttggaaattgcgagaatactttgtaattaccgaatatttgataaagactcatttcgtccctatgtttaaaggcctgacaatggcggacgatctaactgcagtcattaaaaagatgttagattcctcatccggccaaggattgaagtcatatgaggcaatttgcatagccaatcacattgattacgaaaaatggaataaccaccaaaggaagttatcaaacggcccagtgttccgagttatgggccagttcttaggttatccatccttaatcgagagaactcatgaattttttgagaaaagtcttatatactacaatggaagaccagacttgatgcgtgttcacaacaacacactgatcaattcaacctcccaacgagtttgttggcaaggacaagagggtggactggaaggtctacggcaaaaaggatggagtatcctcaatctactggttattcaaagagaggctaaaatcagaaacactgctgtcaaagtcttggcacaaggtgataatcaagttatttgcacacagtataaaacgaagaaatcgagaaacgttgtagaattacagggtgctctcaatcaaatggtttctaataatgagaaaattatgactgcaatcaaaatagggacagggaagttaggacttttgataaatgacgatgagactatgcaatctgcagattacttgaattatggaaaaataccgattttccgtggagtgattagagggttagagaccaagagatggtcacgagtgacttgtgtcaccaatgaccaaatacccacttgtgctaatataatgagctcagtttccacaaatgctctcaccgtagctcattttgctgagaacccaatcaatgccatgatacagtacaattattttgggacatttgctagactcttgttgatgatgcatgatcctgctcttcgtcaatcattgtatgaagttcaagataagataccgggcttgcacagttctactttcaaatacgccatgttgtatttggacccttccattggaggagtgtcgggcatgtctttgtccaggtttttgattagagccttcccagatcccgtaacagaaagtctctcattctggagattcatccatgtacatgctcgaagtgagcatctgaaggagatgagtgcagtatttggaaaccccgagatagccaagttccgaataactcacatagacaagctagtagaagatccaacctctctgaacatcgctatgggaatgagtccagcgaacttgttaaagactgaggttaaaaaatgcttaatcgaatcaagacaaaccatcaggaaccaggtgattaaggatgcaaccatatatttgtatcatgaagaggatcggctcagaagtttcttatggtcaataaatcctctgttccctagatttttaagtgaattcaaatcaggcacttttttgggagtcgcagacgggctcatcagtctatttcaaaattctcgtactattcggaactcctttaagaaaaagtatcatagggaattggatgatttgattgtgaggagtgaggtatcctctttgacacatttagggaaacttcatttgagaaggggatcatgtaaaatgtggacatgttcagctactcatgctgacacattaagatacaaatcctggggccgtacagttattgggacaactgtaccccatccattagaaatgttgggtccacaacatcgaaaagagactccttgtgcaccatgtaacacatcagggttcaattatgtttctgtgcattgtccagacgggatccatgacgtctttagttcacggggaccattgcctgcttatctagggtctaaaacatctgaatctacatctattttgcagccttgggaaagggaaagcaaagtcccactgattaaaagagctacacgtcttagagatgctatctcttggtttgttgaacccgactctaaactagcaatgactatactttctaacatccactctttaacaggcgaagaatggaccgaaaggcagcatgggttcaaaagaacagggtctgcccttcataggttttcgacatctcggatgagccatggtgggttcgcatctcagagcactgcagcattgaccaggttgatggcaactacagacaccatgagggatctgggagatcagaatttcgactttttattccaagcaacgttgctctatgctcaaattaccaccactgttgcaagagacggatggatcaccagttgtacagatcattatcatattgcctgtaagtcctgtttgagacccatagaagagatcaccctggactcaagtatggactacacgcccccagatgtatcccatgtgctgaagacatggaggaatggggaaggttcgtggggacaagagataaaacagatctatcctttagaagggaattggaagaatttagcacctgctgagcaatcctatcaagtcggcagatgtataggttttctatatggagacttggcgtatagaaaatctactcatgccgaggacagttctctatttcctctatctatacaaggtcgtattagaggtcgaggtttcttaaaagggttgctagacggattaatgagagcaagttgctgccaagtaatacaccggagaagtctggctcatttgaagaggccggccaacgcagtgtacggaggtttgatttacttgattgataaattgagtgtatcacctccattcctttctcttactagatcaggacctattagagacgaattagaaacgattccccacaagatcccaacctcctatccgacaagcaaccgtgatatgggggtgattgtcagaaattacttcaaataccaatgccgtctaattgaaaagggaaaatacagatcacattattcacaattatggttattctcagatgtcttatccatagacttcattggaccattctctatttccaccaccctcttgcaaatcctatacaagccatttttatctgggaaagataagaatgagttgagagagctggcaaatctttcttcattgctaagatcaggagaggggtgggaagacatacatgtgaaattcttcaccaaggacatattattgtgtccagaggaaatcagacatgcttgcaagttcgggattgctaaggataataataaagacatgagctatcccccttggggaagggaatccagagggacaattacaacaatccctgtttattatacgaccaccccttacccaaagatgctagagatgcctccaagaatccaaaatcccctgctgtccggaatcaggttgggccaattaccaactggcgctcattataaaattcggagtatattacatggaatgggaatccattacagggacttcttgagttgtggagacggctccggagggatgactgctgcattactacgagaaaatgtgcatagcagaggaatattcaatagtctgttagaattatcagggtcagtcatgcgaggcgcctctcctgagccccccagtgccctagaaactttaggaggagataaatcgagatgtgtaaatggtgaaacatgttgggaatatccatctgacttatgtgacccaaggacttgggactatttcctccgactcaaagcaggcttggggcttcaaattgatttaattgtaatggatatggaagttcgggattcttctactagcctgaaaattgagacgaatgttagaaattatgtgcaccggattttggatgagcaaggagttttaatctacaagacttatggaacatatatttgtgagagcgaaaagaatgcagtaacaatccttggtcccatgttcaagacggtcgacttagttcaaacagaatttagtagttctcaaacgtctgaagtatatatggtatgtaaaggtttgaagaaattaatcgatgaacccaatcccgattggtcttccatcaatgaatcctggaaaaacctgtacgcattccagtcatcagaacaggaatttgccagagcaaagaaggttagtacatactttaccttgacaggtattccctcccaattcattcctgatccttttgtaaacattgagactatgctacaaatattcggagtacccacgggtgtgtctcatgcggctgccttaaaatcatctgatagacctgcagatttattgaccattagccttttttatatggcgattatatcgtattataacatcaatcatatcagagtaggaccgatacctccgaaccccccatcagatggaattgcacaaaatgtggggatcgctataactggtataagcttttggctgagtttgatggagaaagacattccactatatcaacagtgtttagcagttatccagcaatcattcccgattaggtgggaggctgtttcagtaaaaggaggatacaagcagaagtggagtactagaggtgatgggctcccaaaagatacccgaatttcagactccttggccccaatcgggaactggatcagatctctggaattggtccgaaaccaagttcgtctaaatccattcaatgagatcttgttcaatcagctatgtcgtacagtggataatcatttgaaatggtcaaatttgcgaaaaaacacaggaatgattgaatggatcaatagacgaatttcaaaagaagaccggtctatactgatgttgaagagtgacctacacgaggaaaactcttggagagattaaaaaatcatgaggagactccaaactttaagtatgaaaaaaactttgatccttaagaccctcttgtggtttttattttttatctggttttgtggtcttcgt

SEQ ID NO: 162 - protein, 15 aa, Artificial Sequence
  Synthetic: Amino acid sequence of the signal sequence (SS) of SEQ ID NOS: 1, 4, 7, 10, 13, 16, 19, and 22
MFVFLVLLPLVSSQC

SEQ ID NO: 163 - protein, 12 aa, Artificial Sequence
  Synthetic: Amino acid sequence of the membrane-proximal external region (MPER) of SEQ ID NOS: 1, 4, 7, 10, and 16
YEQYIKWPWYIW

SEQ ID NO: 164 - protein, 17 aa, Artificial Sequence
  Synthetic: Amino acid sequence of the transmembrane region (TM) of SEQ ID NOS: 1, 4, 7, and 16
LGFIAGLIAIVMVTIML

SEQ ID NO: 165 - protein, 39 aa, Artificial Sequence
  Synthetic: Amino acid sequence of the cytoplasmic tail (CT) of SEQ ID NO: 1
CCMTSCCSCLKGCCSCGSCCKFDEDDSEPVLKGVKLHYT

SEQ ID NO: 166 - DNA, 10 bp, Artificial Sequence
  Synthetic: Kozak sequence of SEQ ID NOS: 2, 3, 5, 6, 8, 9, 11, 12, 14, 15, 17, 18, 20, 21, 23, and 24
aggagccacc

SEQ ID NO: 167 - DNA, 45 bp, Artificial Sequence
  Synthetic: Nucleotide sequence encoding the SS of SEQ ID NOS: 2, 3, 5, 6, 8, 9, 11, 12, 14, 15, 17, 18, 20, 21, 23, and 24
atgttcgtgttcctggtgctattacctctggtttcgtctcaatgc

SEQ ID NO: 168 - DNA, 36 bp, Artificial Sequence
  Synthetic: Nucleotide sequence encoding the MPER of SEQ ID NOS: 2, 3, 5, 6, 8, 9, 11, 12, 17, and 18
tacgaacaatacataaaatggccatggtacatttgg

SEQ ID NO: 169 - DNA, 51 bp, Artificial Sequence
  Synthetic: Nucleotide sequence encoding the TM of SEQ ID NOS: 2, 3, 5, 6, 8, 9, 17, and 18
ctcgggtttattgctggactaattgcaatagtcatggtcactatcatgctg

SEQ ID NO: 170 - DNA, 117 bp, Artificial Sequence
  Synthetic: Nucleotide sequence encoding the CT of SEQ ID NOS: 2 and 3
tgttgtatgacatcgtgctgctcatgcctcaagggatgttgtagctgtggatcttgttgcaagttcgatgaggatgattcagaaccagttttaaaaggagtaaagttgcattacaca

SEQ ID NO: 171 - protein, 8 aa, Artificial Sequence
  Synthetic: Amino acid sequence of the CT of SEQ ID NO: 4
CCMTSCCS

SEQ ID NO: 172 - DNA, 24 bp, Artificial Sequence
  Synthetic: Nucleotide sequence encoding the CT of SEQ ID NOS: 5 and 6
tgttgtatgacatcgtgctgctca

SEQ ID NO: 173 - protein, 29 aa, Artificial Sequence
  Synthetic: Amino acid sequence of the Vector B VSV-G-CT IND serotype of SEQ ID NOS: 7, 10, 13, and 19
RVGIYLCIKLKHTKKRQIYTDIEMNRLGK

SEQ ID NO: 174 - DNA, 87 bp, Artificial Sequence
  Synthetic: Nucleotide sequence encoding the Vector B VSV-G-CT IND serotype sequence of SEQ ID NOS: 8, 9, 11, 12, 14, 15, 20, and 21
cgagttggtatttatctttgcattaaattaaagcacaccaagaaaagacagatttatacagacatagagatgaaccgacttggaaag

SEQ ID NO: 175 - protein, 20 aa, Artificial Sequence
  Synthetic: Amino acid sequence of the Vector B VSV-G-TM IND serotype of SEQ ID NOS: 10 and 13
SSIASFFFIIGLIIGLFLVL

SEQ ID NO: 176 - DNA, 60 bp, Artificial Sequence
  Synthetic: Nucleotide sequence encoding the Vector B VSV-G-TM IND serotype sequence of SEQ ID NOS: 11, 12, 14, and 15
agctctattgcctcttttttctttatcatagggttaatcattggactattcttggttctc

SEQ ID NO: 177 - protein, 6 aa, Artificial Sequence
  Synthetic: Amino acid sequence of the MPER of SEQ ID NOS: 13, 19, and 22
YEQYIK

SEQ ID NO: 178 - DNA, 18 bp, Artificial Sequence
  Synthetic: Nucleotide sequence encoding the MPER of SEQ ID NOS: 14 and 15
tacgaacaatacataaaa

SEQ ID NO: 179 - protein, 18 aa, Artificial Sequence
  Synthetic: Amino acid sequence of the CT of SEQ ID NO: 16
CCMTSCCSCLKGCCSCGS

SEQ ID NO: 180 - DNA, 54 bp, Artificial Sequence
  Synthetic: Nucleotide sequence encoding the CT of SEQ ID NOS: 17 and 18
tgttgtatgacatcgtgctgctcatgcctcaagggatgttgtagctgtggatct

SEQ ID NO: 181 - protein, 23 aa, Artificial Sequence
  Synthetic: Amino acid sequence of the TM of SEQ ID NOS: 19 and 22
WPWYIWLGFIAGLIAIVMVTIML

SEQ ID NO: 182 - protein, 20 aa, Artificial Sequence
  Synthetic: Amino acid sequence of the CT of SEQ ID NOS: 19 and 22
CCMTSCCSCLKGCCSCGSCC

SEQ ID NO: 183 - DNA, 69 bp, Artificial Sequence
  Synthetic: Nucleotide sequence encoding the TM of SEQ ID NOS: 20, 21, 23, and 24
tggccatggtacatttggctcgggtttattgctggactaattgcaatagtcatggtcactatcatgctg

SEQ ID NO: 184 - DNA, 60 bp, Artificial Sequence
  Synthetic: Nucleotide sequence encoding the CT of SEQ ID NOS: 20, 21, 23, and 24
tgttgtatgacatcgtgctgctcatgcctcaagggatgttgtagctgtggatcttgttgc

SEQ ID NO: 185 - protein, 21 aa, Artificial Sequence
  Synthetic: Amino acid sequence for the Vector B VSV-G-CT IND serotype of SEQ ID NO: 22
KLKHTKKRQIYTDIEMNRLGK

SEQ ID NO: 186 - DNA, 63 bp, Artificial Sequence
  Synthetic: Nucleotide sequence encoding the Vector B VSV-G-CT IND serotype sequence of SEQ ID NO: 23 and 24
aaattaaagcacaccaagaaaagacagatttatacagacatagagatgaaccgacttggaaag

SEQ ID NO: 187 - protein, 49 aa, Artificial Sequence
  Synthetic: VSV-G-TM-CT segment of Vector A
SSIASFFFIIGLIIGLFLVLRVGIHLCIKLKHTKKRQIYTDIEMNRLGK

SEQ ID NO: 188 - protein, 49 aa, Artificial Sequence
  Synthetic: VSV-G-TM-CT segment of Vector B
SSIASFFFIIGLIIGLFLVLRVGIYLCIKLKHTKKRQIYTDIEMNRLGK

SEQ ID NO: 189 - protein, 19 aa, Artificial Sequence
  Synthetic: Leader sequence 1
NEVAKNLNESLIDLGELGK

SEQ ID NO: 190 - protein, 25 aa, Artificial Sequence
  Synthetic: Leader sequence 2
TLFFGDTGLSKNPIEFVEGWFSSWK

SEQ ID NO: 191 - protein, 74 aa, Artificial Sequence
  Synthetic: A segment of VSV-G
TLFFGDTGLSKNPIEFVEGWFSSWKSSIASFFFTIGLIIGLFLVLRVGIYLCIKLKHTKKRQIYTDIEMNRLGK

SEQ ID NO: 192 - DNA, 18 bp, Artificial Sequence
  Synthetic: Nucleotide sequence encoding the MPER of SEQ ID NOS: 20 and 23
tacgaacaatacataaaa

SEQ ID NO: 193 - protein, 23 aa, Severe acute respiratory syndrome coronavirus 2
GSCCKFDEDDSEPVLKGVKLHYT

SEQ ID NO: 194 - DNA, 10 bp, Artificial Sequence
  Synthetic
gaaaaaaaac

What is claimed:

1. A replication-competent attenuated chimeric VSV vector comprising:
   a) at least a portion of a VSV genome comprising at least a:
      VSV-N gene;
      VSV-P gene;
      VSV-M gene; and
      VSV-L gene, and
   b) a nucleic acid sequence encoding an immunogenic variant of a SARS-CoV-2 S protein; wherein
      (i) the nucleic acid sequence encoding the immunogenic variant of the SARS-CoV-2 S protein replaces all of the VSV-G gene in the VSV genome or all of the VSV-G gene in the VSV genome except for a portion of the VSV-G gene encoding a VSV-G protein cytoplasmic tail and/or a portion of the VSV-G gene encoding VSV-G transmembrane domain; and
      (ii) the immunogenic variant of the SARS-CoV-2 S protein has at least 97% sequence identity over its own length to any one of SEQ ID NOS: 1, 4, 7, 10, 13, 16, 19, 22, 25-67, 153, or 158; and
      (iii) the immunogenic variant of the SARS-CoV-2 S protein comprises a C-terminal deletion; and
      (iv) the immunogenic variant of the SARS-CoV-2 S protein comprises one or more mutations relative to SEQ ID NO: 1, wherein the one or more mutations are chosen from:
         i) H655Y, R682K, and R685G;
         ii) H655Y, R682K, R685G, and a deletion of the 9 amino acids (Δ9) at the C-terminal end of the amino acid sequence of SEQ ID NO: 1;
         iii) H655Y, R682K, R685G, and a deletion of the 13 amino acids (Δ13) at the C-terminal end of the amino acid sequence of SEQ ID NO: 1;
         iv) Q321P, H655Y, T678I, and P812R;
         v) Q321P, H655Y, T678I, P812R, and a deletion of the 23 amino acids (Δ23) at the C-terminal end of the amino acid sequence of SEQ ID NO: 1;
         vi) E154D, S115L, T678I, R685G, and M1233K;
         vii) R685G, S813R, and a deletion of the 9 amino acids (Δ9) at the C-terminal end of the amino acid sequence of SEQ ID NO: 1;
         viii) H655Y, R682K, and a deletion of the 13 amino acids (Δ13) at the C-terminal end of the amino acid sequence of SEQ ID NO: 1;
         ix) R685G, S813F, and a deletion of the 9 amino acids (Δ9) at the C-terminal end of the amino acid sequence of SEQ ID NO: 1;
         x) R683G, S813F and a deletion of the 23 amino acids (Δ23) at the C-terminal end of the amino acid sequence of SEQ ID NO: 1;
         xi) R683G, S813F, R685G, and a deletion of 23 amino acids (Δ23) at the C-terminal end of the amino acid sequence of SEQ ID NO: 1;
         xii) H655Y, P681S, R682K, and a deletion of the 13 amino acids (Δ13) at the C-terminal end of the amino acid sequence of SEQ ID NO: 1;
         xiii) R683G and a deletion of the 23 amino acids (Δ23) at the C-terminal end of the amino acid sequence of SEQ ID NO: 1;
         xiv) H655Y and a deletion of the 23 amino acids (Δ23) at the C-terminal end of the amino acid sequence of SEQ ID NO: 1;
         xv) R683G, D1118A, and a deletion of the 23 amino acids (Δ23) at the C-terminal end of the amino acid sequence of SEQ ID NO: 1;
         xvi) R683G, N715S, and a deletion of the 23 amino acids (Δ23) at the C-terminal end of the amino acid sequence of SEQ ID NO: 1;
         xvii) H655Y, N709S, and a deletion of the 13 amino acids (Δ13) at the C-terminal end of the amino acid sequence of SEQ ID NO: 1;
         xviii) F140V, H655Y, and a deletion of the 23 amino acids (Δ23) at the C-terminal end of the amino acid sequence of SEQ ID NO: 1;
         xix) a deletion of the 21 amino acids (Δ21) at the C-terminal end of the amino acid sequence of SEQ ID NO: 1;
         xx) a deletion of the 19 amino acids (Δ19) at the C-terminal end of the amino acid sequence of SEQ ID NO: 1;
         xxi) E484D, H655Y, and a deletion of 21 amino acids (Δ21) at the C-terminal end of the amino acid sequence of SEQ ID NO: 1;
         xxii) H665Y, R685G and a deletion of the 19 amino acids (Δ19) at the C-terminal end of the amino acid sequence of SEQ ID NO: 1, wherein the SARS-CoV-2 S protein further comprises a fragment of at least 21 amino acids at the C-terminal end of a VSV-G protein;
         xxiii) D614G; and
         xxiv) D614N.

2. A recombinant VSV particle comprising the vector of claim 1 and displaying of the SARS-CoV-2 S protein or the immunogenic variant of the SARS-CoV-2 S protein on the surface of the VSV particle.

3. A recombinant VSV particle comprising a replication-competent attenuated chimeric VSV vector comprising:
   a) at least a portion of a VSV genome comprising a VSV-N gene, VSV-P gene, VSV-M gene, and VSV-L gene and
   b) a nucleic acid sequence encoding an immunogenic variant of a SARS-CoV-2 S protein; wherein
      (i) the nucleic acid sequence encoding the immunogenic variant of the SARS-CoV-2 S protein replaces all of the VSV-G gene in the VSV genome or all of the VSV-G gene in the VSV genome except for a portion of the VSV-G gene encoding a VSV-G protein cytoplasmic tail and/or a portion of the VSV-G gene encoding VSV-G transmembrane domain, and
      (ii) the immunogenic variant of the SARS-CoV-2 S protein has at least 97% sequence identity over its own length to any one of SEQ ID NOS: 1, 4, 7, 10, 13, 16, 19, 22, 25-67, 153, or 158; and
      (iii) the immunogenic variant of the SARS-CoV-2 S protein comprises a C-terminal deletion; and
      (iv) the immunogenic variant of the SARS-CoV-2 S protein comprises one or more mutations relative to SEQ ID NO: 1, wherein the one or more mutations are chosen from:
         i) H655Y, R682K, and R685G;
         ii) H655Y, R682K, R685G, and a deletion of the 9 amino acids (Δ9) at the C-terminal end of the amino acid sequence of SEQ ID NO: 1;
         iii) H655Y, R682K, R685G, and a deletion of the 13 amino acids (Δ13) at the C-terminal end of the amino acid sequence of SEQ ID NO: 1;
         iv) Q321P, H655Y, T678I, and P812R;

v) Q321P, H655Y, T678I, P812R, and a deletion of the 23 amino acids (Δ23) at the C-terminal end of the amino acid sequence of SEQ ID NO: 1;
vi) E154D, S115L, T678I, R685G, and M1233K;
vii) R685G, S813R, and a deletion of the 9 amino acids (Δ9) at the C-terminal end of the amino acid sequence of SEQ ID NO: 1;
viii) H655Y, R682K, and a deletion of the 13 amino acids (Δ13) at the C-terminal end of the amino acid sequence of SEQ ID NO: 1;
ix) R685G, S813F, and a deletion of the 9 amino acids (Δ9) at the C-terminal end of the amino acid sequence of SEQ ID NO: 1;
x) R683G, S813F and a deletion of the 23 amino acids (Δ23) at the C-terminal end of the amino acid sequence of SEQ ID NO: 1;
xi) R683G, S813F, R685G, and a deletion of 23 amino acids (Δ23) at the C-terminal end of the amino acid sequence of SEQ ID NO: 1;
xii) H655Y, P681S, R682K, and a deletion of the 13 amino acids (Δ13) at the C-terminal end of the amino acid sequence of SEQ ID NO: 1;
xiii) R683G and a deletion of the 23 amino acids (Δ23) at the C-terminal end of the amino acid sequence of SEQ ID NO: 1;
xiv) H655Y and a deletion of the 23 amino acids (Δ23) at the C-terminal end of the amino acid sequence of SEQ ID NO: 1;
xv) R683G, D1118A, and a deletion of the 23 amino acids (Δ23) at the C-terminal end of the amino acid sequence of SEQ ID NO: 1;
xvi) R683G, N715S, and a deletion of the 23 amino acids (Δ23) at the C-terminal end of the amino acid sequence of SEQ ID NO: 1;
xvii) H655Y, N709S, and a deletion of the 13 amino acids (Δ13) at the C-terminal end of the amino acid sequence of SEQ ID NO: 1;
xviii) F140V, H655Y, and a deletion of the 23 amino acids (Δ23) at the C-terminal end of the amino acid sequence of SEQ ID NO: 1;
xix) a deletion of the 21 amino acids (Δ21) at the C-terminal end of the amino acid sequence of SEQ ID NO: 1;
xx) a deletion of the 19 amino acids (Δ19) at the C-terminal end of the amino acid sequence of SEQ ID NO: 1;
xxi) E484D, H655Y, and a deletion of 21 amino acids (Δ21) at the C-terminal end of the amino acid sequence of SEQ ID NO: 1;
xxii) H665Y, R685G and a deletion of the 19 amino acids (Δ19) at the C-terminal end of the amino acid sequence of SEQ ID NO: 1, wherein the SARS-CoV-2 S protein further comprises a fragment of at least 21 amino acids at the C-terminal end of a VSV-G protein;
xxiii) D614G; and
xxiv) D614N.

4. The recombinant VSV particle of claim 3, wherein the VSV particle displays the immunogenic variant of the SARS-CoV-2 S protein on the surface of the VSV particle.

5. A SARS-CoV-2 vaccine comprising the replication-competent attenuated chimeric VSV vector of claim 1.

6. The replication-competent attenuated chimeric VSV vector of claim 1, wherein the immunogenic variant of the SARS-CoV-2 S protein comprises an amino acid sequence having a length of at least 1223, 1228, 1233, 1238, 1243, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277 or 1278 amino acids.

7. The replication-competent attenuated chimeric VSV vector of claim 1, wherein the C-terminal deletion comprises a deletion of 9, 13, 19, 21 or 23 amino acids.

8. The VSV vector of claim 1, wherein:
a) the replication-competent attenuated chimeric VSV vector is rVSVΔG-SARS-CoV-2 clone MB2 (SEQ ID NO: 154); or
b) the replication-competent attenuated chimeric VSV vector comprises nucleic acids encoding
i) VSV L protein (SEQ ID NO: 152);
ii) VSV N protein (SEQ ID NO: 155);
iii) VSV P protein (SEQ ID NO: 156);
iv) VSV M protein (SEQ ID NO: 157); and
v) immunogenic variant of the SARS-CoV-2 S protein (SEQ ID NO: 158).

9. The recombinant VSV particle of claim 2, wherein the particle comprises VSV and SARS-CoV-2 proteins from MB2 comprising:
a) VSV L protein (SEQ ID NO: 152);
b) VSV N protein (SEQ ID NO: 155);
c) VSV P protein (SEQ ID NO: 156);
d) VSV M protein (SEQ ID NO: 157); and
e) immunogenic variant of the SARS-CoV-2 S protein (SEQ ID NO: 158).

10. The replication-competent attenuated chimeric VSV vector of claim 1, wherein:
a) the replication-competent attenuated chimeric VSV vector is rVSVΔG-SARS-CoV-2 clone MB1 (SEQ ID NO: 150); or
b) the replication-competent attenuated chimeric VSV vector comprises nucleic acids encoding
i) VSV L protein (SEQ ID NO: 152);
ii) VSV N protein (SEQ ID NO: 155);
iii) VSV P protein (SEQ ID NO: 156);
iv) VSV M protein (SEQ ID NO: 151); and
v) immunogenic variant of the SARS-CoV-2 S protein (SEQ ID NO: 153).

11. The recombinant VSV particle of claim 2, wherein the particle comprises VSV and SARS-CoV-2 proteins from MB1 comprising:
a) VSV L protein (SEQ ID NO: 152);
b) VSV N protein (SEQ ID NO: 155);
c) VSV P protein (SEQ ID NO: 156);
d) VSV M protein (SEQ ID NO: 151); and
e) immunogenic variant of the SARS-CoV-2 S protein (SEQ ID NO: 153).

12. The replication-competent attenuated chimeric VSV vector of claim 1, wherein the VSV-M protein comprises a Y61S mutation relative to SEQ ID NO: 157.

13. The SARS-CoV-2 vaccine of claim 5, wherein the SARS-CoV-2 vaccine is formulated for oral administration.

14. The SARS-CoV-2 vaccine of claim 5, wherein the SARS-CoV-2 vaccine is formulated for intranasal administration.

15. The SARS-CoV-2 vaccine of claim 5, wherein the SARS-CoV-2 vaccine is formulated for oral mucosal administration and intranasal administration.

16. An isolated recombinant cell comprising the replication-competent attenuated chimeric VSV vector of claim 1.

17. The replication-competent attenuated chimeric VSV vector of claim 1, wherein the portion of VSV-G gene remains in the replication-competent attenuated chimeric VSV vector and the portion of the VSV-G gene remaining only encodes a VSV-G protein cytoplasmic tail, a VSV-G protein transmembrane domain, or a VSV-G protein cytoplasmic tail and transmembrane domain.

18. The replication-competent attenuated chimeric VSV particle of claim 3, wherein the portion of VSV-G gene remains in the replication-competent attenuated chimeric VSV particle and the portion of the VSV-G remaining only encodes a VSV-G protein cytoplasmic tail, a VSV-G protein transmembrane domain, or a VSV-G protein cytoplasmic tail and transmembrane domain.

19. The SARS-CoV-2 vaccine of claim 5, wherein the portion of VSV-G gene remains in the replication-competent attenuated chimeric VSV vector and the portion of the VSV-G remaining only encodes a VSV-G protein cytoplasmic tail, a VSV-G protein transmembrane domain, or a VSV-G protein cytoplasmic tail and transmembrane domain.

20. The isolated recombinant cell of claim 16, wherein the portion of VSV-G gene remains in the replication-competent attenuated chimeric VSV vector and the portion of the VSV-G remaining only encodes a VSV-G protein cytoplasmic tail, a VSV-G protein transmembrane domain, or a VSV-G protein cytoplasmic tail and transmembrane domain.

* * * * *

UNITED STATES PATENT AND TRADEMARK OFFICE
CERTIFICATE OF CORRECTION

| | |
|---|---|
| PATENT NO. | : 12,311,021 B2 |
| APPLICATION NO. | : 17/180147 |
| DATED | : May 27, 2025 |
| INVENTOR(S) | : Christopher Lee Parks et al. |

It is certified that error appears in the above-identified patent and that said Letters Patent is hereby corrected as shown below:

In the Claims

Claim 1, at Column 129, Line 39:
The first occurrence of T678I should be corrected to T678I Claim 2, Column 130, Line 31, should read as:
A recombinant VSV particle comprising the vector of claim 1 and displaying the SARS-CoV-2 S protein or the immunogenic variant of the SARS-CoV-2 S protein on the surface of the VSV particle.

Claim 3, at Column 130, Line 67:
The first occurrence of T678I should be corrected to T678I Signed and Sealed this
Twelfth Day of August, 2025

Coke Morgan Stewart
*Acting Director of the United States Patent and Trademark Office*